United States Patent 10,407,724 (METHODS AND COMPOSITIONS FOR SCREENING AND TREATING DEVELOPMENTAL DISORDERS) - sequence listing, part 32

SEQ ID NO: 629 - DNA, 1841619 bp, Homo sapiens
cttagagtgaacaattcaaggttctaaataacttagaaaagattcccctgcaggcacgatgcaagacaaattcacttactatttattgctgggtcattggtagcccttcatccctcgctaagcagaacctcagggggctgtacctgggaggcatgtatagatgtcccggtaagaatgaacacagaagatgagagaatgacagcgggagaggaagggagggatgcagagggaaacgcaaacatccagactaaaaagcacctttagccttcacctcctgccactgccctctgatcccaagcagggcttggaatccagagaggggctgcctccctcaagtcattccccctttcctttattcctgtgaccaattacagatcagtgaagcttaagttttttgcattcacctttttttttttttttttgaaataaagttttgctcttgttgcccaggctggagggcaatggtgcgatcttggctcactgcaaccaataaggtggacctcccggattgaagtgattctcctgcctcagcctcctaagtagctgggattacaggcatgcaccaccacgcccggctaatttttgtatttttagtagagacagggtttctccatgttggtcaggctggtctcgaactcctgacctcaggtgatccacccacctccgcctcccaaagtgctgggattataggcatgagccaccacgcccggccagcagattcacctttcaatctcccttcccatttccctcctaatcccaaacacccacatgtcagtctgagtgcttggttgtaacagatggtctcccttttcccctccagtttatcctgtacgcagctgtcagacaattttttctgtgtgtcactttctgctcaaggaacttgctggggaatctccattatcactggtcccacagtccacgtctctgtctggctttcagggcccttcataatttcactccattctctcaaccaggtttatttctcatcagtactcacactcacactccttcttgccacactcatgactttgttgatgctgtgcccttacccggaactgttctcctcccaccacgcagccaaaccaaattcaacccatcccacacacccacctgaagatggttttcccctggctgagctgagctgacctggcactattctcaatgcccagtgcatggacattaccacatagcctggtactgaagcattttccaactatttcatgcttagtaattatctctccatggactctaaatgccttgaggataggaatcatcttctattctcctatatatctccctgggcctagactaacgctgagcaatagaaatcatgttatcactcaagttataatgagaagaggaaactttttattttgttagatctctctggggaagtgctatatgtgcttggaagaaacatgctgacaagcttactgaggataagaaggaggcctcccagggcattctcaagcaacgaaagacgtttgctgaattattcgccagaagatcaggagagtactttatggagcttgtgagaaaaaggaaaagcaaaaagagaataagaaatgagacagggatgctgtacattgtattaaaatgagatgcctgtacccccaaaccctgagtaaaattctattaaaactcaaaaaacagctgtctaggtggatttctggtggaaaccagtgaaggggccaagatttctatggagggtaatgtgaggttttgagatagatgcaaacaggagccagatggacacggaggccttgactagcatttggattatattccaatatatgattgatcaattggccagtatggagaattatcatggaaatgcgtgtggtggctcactgaccccagatgtatatttctcctgcctcttccatctcactactatctatttgaggaagtattaaagtgaaggccacatcagactctgtaggataacaggtagccacaaagtctttattcataaaatccacttcaggctgggtgtggtggctcatgcttgtaatcccagcactctgggaggcagaagctggcaaatcatgaggtcaggagttcgagaccagcttggccaacatagtaaaacctagtctctactgaaaatacaaaaattagccaggtgtggtagcatgcgcctgtagtcctagctactcaggaggctgaggcaggaaaatcgcttgaactcaggaggtgaaggttgcagtgagccgagaccacgccattgagctccagcctgggtgacagagtgagactccatctcaaaaaaactaaaactaaaaataaataaaataaaatccacttccaaaacattctttttaaactgtgagtgtgtttggttcttagctcacctcaaggttaggtaagttacccactcagtgagcatacatctggcgattagcttgggtttcggtggttgcttcaggtatactcagggtgtaggtggaatttggcactcgctggttgagtcatttataattgtccaaatttgaggaggtatgaattatgccatctcagctagattaaaaatggaatgcacggtcttctagatgctttgatttcatcaatattataatcctggagaaaataaacatttcatttataagacatgacagatgcttggtaagtactccagatactgtaggtgctcagttcaagtctgttaataaatgcagactttgttcattacattaagtaaaaatgtaaaagcaagcagggtatgtattagtgttctccagagaaacagaactaatagggaatggatataggtatagatgtttcagtccatttttttgttgcttagaacagaatacctaaaactgggtaatttatttttttatttgtatttatttatttttgagacaaagttttgctcttgtcgcccaggctggagtgcagtggtgcgatctcggctcactgcaacctccgcctcctgggttcaagcaattctcctgcctcagcctcccaagtagctgggactacaggcacccaccaccacgcctggctaatccattcatgaaggcagagttctcatgacccaatcacctcttaaagtccccacttctcaatactgccacattgggggttaaatttcaatgtaagtttcagaaggggacaaatattcaaaccatagtaatagatgtataaagagattttttataaggaattggctcacacaattatggaggtcaagaagtcccaagatctgcagctggcaagctggagactcaggagagttgttagtgaagttttttgtttttggtttttggggggtttttttgagacagagtctcgctctgtcgcccaggctggagtgcagtggcatgatctcagctcaccgcaacctccgcctcctgaggctgagattctcctgcctcagcctcccaagtagctgggactacaggcatatgccaccacacccggctaatttttgtatttttagtagagatggggtttcaccatgttggccaggctggtcttgaactcatgaactcaggtgatccacccgcctcagcctctcaaagtgctgagattacaggcatgagccaccatacccagccaatgatgaagatttgatccaatgtttggtaggctcaagacccaggaagagctgatgttttagtctgagtccaaaggcaggacaaacagtcaatcaggcaggaggaattttttgactcttgggaggagtagccttttgttatatttaggccttcagctgattggatgaggcccaccaacattgggaagggcaatctgctttattcagtccaccaattcaaatgtcaatcacatccacaaacacccttacagacacacggaataaggtttaaccaaatgtctgggctccctgtggcccagtcaaattgacacataaaattaaccatcacaaggtacaacattgaattccaattatataaaatataaactcaggcaaaattaatatattctgtaacaaagtcaggagagtgtctgctctggagagaaagagaaggggcttgaatggcttctggttattggtaatgtcttatttcctgatttgatgttggttatacaggtatgttcaccttgtgaaaatttatggagctatccactagggatttatgcccttttctcaatgtatactatgcttcaattcaacattatttatttgtttgtttgtttgtttattgagacagagtcttgctctgtcacccaggctggagtgcagtggtgcgatctcggctcactgcaacctccacctcctgagttcaagtgactctcctgcctcagcctcccaagtatctgggattacaggtgtgtactacaatgcctggctaatttttgtaattttagtagagatgggtgttaggaacaggcccccaaatctggccataaactggccccaaaactgggcataaacaaaatctctgcagcactgtgacatattcttgatggccatgacgcccatgctgaaggttatgggtttaccggaatgagggcaaggaacacccggcccacccagggcagaaaaccgcttaaaggccttcttaagccacaaacaatagcatgagtgatctgtgccttaaggacatgctcctgctgcagataactagccagacccatcccttcgtttcagcccatccctttgtttccattaaggaatacttttagttaatctataatctatagaaacaatgcttatcactggcttgctgtcaataaatatgtgggtaaatctctgtttggggctctcagctctggaggctgtgagacccctgatttcccactccacaccctatatttctgtgtgtgtgtctttaattcctctagtgccactgggttagggtatccacaaccaagctggtctcggcagacgggtttctctgtttcccaggctggtctcaaacttgtggcctcaagcaatctgcctgcctcagcctcccaaagtgctgggattacaggcatgagccaccatacccggcaattcaacatattttactggggtgatgggagtgggcatgtggaatgtcttaggagataacactgctataaattccttccaacaagcttacgttttcttggctagaattgttcagcctctcagaatccctggataggaagttggatcatgcagctcctgtctgggttccattaagttaaagctcagttagttcgaggggcatctcttttgcctcaagagaagttcctgaaaggaaggacaacagtgagttctggctatgggacccttattgccaaaagcacaggagcccagtccaatcacagcaggtgccaaacctatcgatctaggaaaagatgacctagccgaggtcacatcatgcaagaaccttgcagccattggttccttccatttttgttgctgtcgtgctttctcagagtctccttctgaacattgttgctttgaaatttctgggcagcaagaaactgatataagacctgattcctctctgattctgtgggaaaaccacagccccaaagggagttttggttgatttttttgaagacatgttgcccaaaggactttttttccttctagttttttcaagtgcatattcgttgagacccaatcctctggcacccattgaagtagagatccaccgattaggttagccaaggcagagaactgatctaaatgatttgggctccaaattaaaattttgatctgaatccagtgccttgttaaaattcttcacattgagcttcgcctttcatttggtagaacgtttatttaggcattgtgtcatatgatgggaaaagattgacatggtttaggattccggctcagccacccacttgctgagtaaccattggtagatgatttaacctctttgaggctgttttctcaaactcagtattgagggatgaattaaaatgtgtatatgaggctgggcatggtagctcatgactgtaatctgcactttggaaggctaaggcgaaaggatttcttgagcccaggatttcaaaaccagcctaggcaacatagtgagacacaatctctacaaaaaattactaataaaaaattagccggggccatgtgtgatggctcacgcctgtaatcccagcactgtgggaggccgaggtgggcagatcatgaagtcaggagtttgagaccagcctggccaatatggtgaaaccccatctctactaaaaaatacaaaaattagcagacatgatggcgcatacctgtaatcccagctacttgggaggctgaggcaggagaatcgctggaacctgagaggtggaggttacagtgagccgagatcgtgccactgcacttcagcctgggcaacagagcgagactttgtctcaaaaaaaaaaaaaaaaaaaaaaaaaaaaattagctgggcgtggtggtgcgcaccagtagtctcagctacttgggagcgtaaggtgggaagattgctttagcccaggaggttgaggtggcagtgagctgggtttgcaccacggcactctagcctgagcgacagagtgagactatgtctcaaaaacataaataaataaataaaaaacatacatgcaaagtgcctaaaccactttagttactcaggtaagtaataaacattcatcatcatcatcatttcaatatcctgtgaagtcagtgtagacctggcctaatgcagtcaaagtggtttaactcaaaaagcacgtaaacgtctttattccacgggaagtgtgtagctttacagcccgcaggagacatttaaatagaatctagacaacgttcagatcatcaacaggttttgaatctcccagattagaatatttgtgattatgtgagcttgacatcaatgaaatggaataaataaaatgttcattgctctgttgcccaggctggagtgcaatggcacaattatagctcactgcagcctcgacctctcagtctcaagtgatcctcctacctcagcctcctgagtatctgggaccacaggcatgcaccaccatgcccagctaatttttgtgtattttgtagagatggggtcttgctctgttgcccaggcttgtctcaaattcctgggctcaagtgatcctcccacctcagcctcccaaagcacaggcataagccaccacacccagccattctaataactttggtgtatctggcttgatgtttatattagatttgattgatctttttgatggacatgagtgggtggtagaaaagagagtatttacttgtgttttgatgaactggtggatttttttaattttgaaaaatataattcacaataacataattcaaaaatatctaataaatgtgttttagaatggctattgatagtgaagaaatcttatgggttagggtgtttcacactgatttatttgtattgctgaccttagaaaaattaatttctgaaccaggagtggtgactcacgcctataatcccagcacttagggagtaccatgcgggtggatcacttgaggctagcctggccaacatggtgaaatgctgtctctactaaaaatacaaaaattagctgggtatggtggcgcgtgcctgtaagttcagctactcgggaggctgaagcaggagaatcgcttgaacctgagaggtggaggttgcagtgagccgagattgcgtgccactgcactccagcctgggcaacagagcaagactccatctcaaaaaaaaaaaagaaaaaaaaaattaatttctggccaggtgcagtggcttacccctgtaatcccagcgcttttggaggctgaggcaagaggattgcttgaagccaagagttcaagaccagcctgggcaacaaagcgacacctctgtctccacaaaaatctaaataaataaataaatcagccagctggggtggtgtgtgcctgcagtcccagctactcaggaggctaaggcaggaggattgcttgagcctgggagtttgaggttacagtgagctacgatcacaacactgcactccagcctaggtgacagagtaagacccagtttcttaaaaaaaaaaataataacagctgggcacggtggctcacacctgtaatcccaacactttgggaggccaaggcaggtggatcacaaggtcaggagttcaagaccggcctggcctacatagtgaaaccctgtctctactaaaaatacaaaaaattagccaagcgtggtggcaggcgcctgtaatcccagctacttgggaggctgagacaggagaatcacttgaacctgggaggtggaggttgcagtgagcagagattgtgccactgcactccagcctgggcaacagagcaagactctgtctcaaataaaataataataataacaaaagaaattaatttccttcacagtagtttaccaagtgtgacagcaaaagtactgaggttaacaagcattttggaaatgtgatttctgaataaagtaatgagtttttttttctttgcaagtggagagaaacttcctctttgtgaaatttcatgtcagataaacccaaggtataagctgaaataaaaacaattatgtaatcgctcttcttcatcttacctcctttttaaggaatataaactattggtaatgtactagtgagaattctaatgtgtgagtcatagcctgtgaatcatggtaacgcatcagaaggctctgattgggagaactgaattatagtcctcttcctgcactaaaataataacctcctcccacaggggctcaaagaaaaacatggttttccagcaatgaactttaacttctcttctttattttttcctggtttgatttttatgggaatctgctctaggatggctggctcctctaagacttacattatttagagtcgtcttccataccgggtgtaattcttgcgctcacggtctctctctctctcgctctcatctttcttgtacttatttgctgttatttctacaaagataagacaataacaggtaacttgtttttacagcgtacagtttacaaagcactttcataaatatctcatttgagcttcttagcagctttatagaaaaacataaattattactcatttctacagatcgggaaacctaggcccaagagaggtaagtgacttcccaaagtacagtgcctcttgatatcaagtcaagtaaatcaaatccctcttcagcttggtggacaccaccccgcatggttatcacagcaggaagatggagggtgggtggtcaaatgctaacacagtgagagcactagactttcttttatggcaaagagcacagtcacttacagagatgtttgtaccatgcaggagacagcatggctgactcccaggtggagttaggagctgcccaggtctgcaggtccccagggagggatagctttggaggacacccaggcaaactgaggattccagcagacacgagaagctcacctcagctgctctaatggggtggtggccagcggggttaaacctatctatcctgccccccaaaacacaccctcctcagctgcctatcctgggacaggacacaccctcttggctccccacccacaagttactagcatgaaacaaacccagcgaactcaattcaaggaaagggaaagctcgttttctaggcatagggtcctgcagtggggccgggcttccagcctggttgtgcttcagggctgcacactcacacaaaatgtctcatggagtagatgactcgttcactcaagaaccagccatcgatggcctgtggttacagaatggaagacacagtgaagcaggggaattataaatggggtgctcaatgtaaaccagattgtttgttttgcccctctcccctctctctcatctgtctttcttgtcctttatgccccaatggcacctgtggggtcccttccccaagcaaagctgctggcacctacacacagagagcatgacgctcatagaggctctccaggaggaccgaagtgcccacagaagcaccagtcagtgtagcctgaggctgcccaggcccagaacctccacccctctgttctcagccacccagagtcatacccttaacctcatcattatccagacctacagcgcctacacccgctctccaaccactcctgaccatgtcctctatctgtccagcttactccctcggccccccaattccagcaatcctgtgagccaccaagacctacagtcctgccctatagagacctcaccaccttctcactgtcccccagcccccacgtcctcccctccctcctgatccaatcatgacggtcattcatctgcttataccctccgacttcttcacctctttctcgctttgaggttctctctgatgaaatcacacccctggttaaatggaactctccagccgctctgggcctgcatcgccccatggctggagaacaaactcagtcagcctctgttcaccctttgcattgctgacaaaatccagtgggccctgactgatgctccacaaacgtatcacacttctctcgtctcctctctcccactctcccaggtgatgatttcataccttctcctctctctctacaccttcaacacctcctccccctcctccctctcagcaactttgcttcctatgccaccaagaacatcgcagccaccagaaaagagctcctacgtgctctcaccagcgcgcccacccaccccccgtgtctgtgtctgagcactcagccttctccccgcggcgtgggtgagctgccctgcccccacctgcccctccgtgggatgggatcccagcccctgcggcccactcgcggacatctctcctgccgctctgtcttctctctcctgcacctccgcattttccttctcgattgaattaatcccatcagctcataaacatactgtatttctcccatcttaagaagaaaagaaaaaacagctctcttcacttcacttccccctccagcttccactccacttctctaccttctttcacaacaaaactccttgaaagaatggaggacactcttcttctctctgcctctgatttctctcctccggtcctcactcgaattcaccacagctggacttttgcccccaccatgccactaaatcagtgttcaggtcactggtgaattccatggtcacctgtcggccctcttcttgcttgacccgttggtgacatgacatgcaactgacgctgtctcctccttgaaccgccttcttctctcggtttccaggatgctgcccactcctggttctcctcctgcctttctagacaccgtctctcaagcacttttgttggttttgttggtggtggtggtggtggttttgagacaagatcttgccttgtcacccaggatggagagcagtggcccaatcaaagctcactgcagccttgacctcccaggctaaagtgatcctcccacttcggcctcccgagtagctgggaccacaggtgcccaccaccacacctggctaatttttaaatgtttaatagagatgaggtctcgatatgttgcccaagctggcctcaagccatccccccacctcagcctcctaaagtgctaggattacaggcgtgagctgccgcgcccggccttgttggttctttttcctatccttgactaaagtgctgggattacaagtgtgagccgccgcgcctggccttgttggtttttttcctatcctcctatccttgactaaagtgctgggattacaggcatgagccgccgcgcccggccttgtttgtctttttcctatccttgacctctaactgtcagtgtgctccagggctcaatcctcggacgttctcttgcatacctatactcaatgctgaggaaatctcagcttgtcttatggctttaaatactgcatatctgataggtgtagatggatatgatggatataacgatgattctctaattttttttggagatggagtctcactctgtcgcccaagctggagtgcagtggcatgatctcagctcactgcaacctccgcctcccaggttcaagtgattctcctgcctcagcctgccaagtggcccaagtagctgggattacaggcacctgccaccatgcccggctaatttttgtatttttgtagagatggggtttcaccatgttggccaggctggtctcgaactcctgacctcaagtgatttgcctgcctcgacctcccaaagtgctgggattacaggcatgagccactgctcccagcctgattctctaatttttatcatcaggaagaccctttcccctgagctccacacccacctacccactgccattagacgatgggcatctccagcctcacagagctcccagttctccactcagccagccttttggcagtctccccatttcagttcaaggcaactttattcttctagttgctcagaccaaagacattcctcagtttgcattctctcaccccacacagccagctcattaggaagtcttgttggcaataccttcaaaatacatccaaacccaattcctttccatctcccccactgccaccatcattcctcacctgggttacttcagtagtgtcctaacaggccccacggctctgtcttcaccccgttgcaacctactctcagcagttttcagaaagatctgattcaattctgtcactcccctccttaaaagccttctctaaatgcattttcagttagagaaaagctgtagaccttagcgtgggcctgcagcccctagctgactctgcctcttatctctccgcgctcttccctgctgacccccatcccctgtgctgcagccacactgacccccttgagcacacgccaggctttagggctggtcctttccactctgtctgcctgggctgctctgaccccagacaggctgctctaaaaaggctcacccttctccagcttttcctactcaccctgcctgctatttttttctccttagcactactgccatcaaacatactatatgtggctgggtgcaatggctcacacttgtaatcctagcactttgggaggccaagacacagatcacttcaggtcaggagttcaagaccggcctagccaacatggtgaaatcccgtctctactaaaaatacaaaaattagccaggcatggtggcaggtgcctgtaatcccaactatttgggaggctgaggcaagagaatcacttgaacctgggaggtggaggttgcagtgagccgagatcatgccattgcactccagcctgggcaacagagcaagattttgcctctaaataaataaacaagtaaataacatatgctgtacttactaaccttgttaattgtctgtcccccctctaaaatgccattgggagtgggggttttttctgtttgggtcactgccatgtcccgatgtccacgggcgttcacggcagccacgtggcgagtgctcacaaatgtgtgcagtttcgtggacaggaaggtctaggctgaagcaagtgggatgatcccacagcctgactatcttagtagtcacccatgaggatggttttcagagccctcaccctcatgtaccgcagagaaacgactgcagcctggcccctctctgacttcccctccttcaagccaccgcagaaacagcaaggccgtgaagagcgtaacgagagagccagcagggcccgggctgacctcagcctctgacacttcggattttcatgctgggaaaaacatttcatctctctaaacctcagtttggtttttttttttttttttttttttgagacctagcccactctgttgtccaggctggagcacggtggagtgatcttggctcactgcaacctccacctcccgggttcaagctattctcctgcctcagcctttcaagtagctgggattacaggcgtgtgccaccacacccggctaatttttgtatttttagtagagatgtggtttcaccttgttggcggggctggtctcaaactcctgacctcaagtgatccacccgcctcagccttccaaagtgctgggattacaggtgtgagccgccgtgcctggcctaaacctcagtttcttaaccagtaaaatgagaataatgctacctacttcataggactactgaagggtgaaatgaaacagtgtgtgtaaagtacttagtacagtggctgacacagagcaggcacttggagaatggagattatttttattagtagtaagaaaagttataggaaggtgggtgtgggggctcacacctgtaatcccagctgctcctaaggccgacgttggaggatcgcttcggcccaggagtttgagaccagcctggaccacataactatcccccaactctgaaaatcgattaaaaattagctggagagggtgacacatgcctgtagtcccagccaccggagaagctgaggcaggaaaatggcttgagttcaggagtttgaggctgcagtgagctataatcaccccagtgcactccaggctggatgacagagtaagacctcatctcttcaaaaaaggaaaaaaagaaaaaagttacagcagctgtaggttcttggctcttgacttgggaagaatttcactgataattttttttaagttgatattttgtattttcattattttacctttgttagtattattcacaacaaagcagtgtcgagaacaatgatcacatttctcctcttctataacttattggttgtcctggagtttaatttttaggcttctccttttcttttttttttttcatttttgaaattgagatatgtttagattaaacgcagagatcttaaatgttacagtttgacgtgttttgaaaaatatgtacatggctgaaactcatatttctaaaaaaaaatgagtgtttccaatataccattaagttcactggggcccccttacagtcaaatcttatacaccacaacccctcagatgatcaaggttcagatttctttgaacataaattagttttgcccatttagagattcatctagctgtgtaagtcttctttcattgagaaaaagattttaaattcctccacattcgtggctatatcaatcgttggaaacttttaattattgcctagtattgttttattattatacttgaagttctagggtacatgtgcacaacgtgcaggtttgttacatatgtatacatgtgccatgttgttgtgctgcacccattaactcgtcatttacattaggtatatctcctaatgctatccctcccccctccccccaccccacaacaggccccggtgtgtgatgtcccccttcattcactgatgatttaaaaacagcttgtttatgattgcaaggacccaaatggttgctcgctgtctccatagaagctgacgggaagaaatgtgcttgagctacaacaggcagtggccaagtcaacctacggaagtcttgtctgatcataagaggttgaagccacagaagcaggcttatccaaagaagctgtgacagctcatcaggacagatccttaaagagtggcataccctaggctgggtgtggtggctcaggcctgtaatcccagcactttgggaggctgaggcgggcagatcgcctgaggtcaggagttcaagaccagccaggccagccgtctctactaaaaatacaaaaattagccgagcatggtggcgcatgcctgtaatcccagctacttgggaggctgaggcaggagaatcgctggaacccaggaggtggaggttgcagtgagccaagatcatgccactgcactccagcctggatgacagagcgagactctgtctcaaaaaaaaaaaaaagactggtgtatcctggtgtgtctagtcatagagtccctgcagctttctgggtgagaagtctgtgatggaaacagcatggaagcctcaaactccatggataaatggggcagctgaccagacagctgtgaactaacaggtctacactgcaaatgcaaaatattgcaggccccatactccacttgttaatactcctctctgccctttaaatatatatatatatttgaagtcttccgcttctcagcttgcttccatccccctcctcagtgcttgttgatgggattcaagcactcacccctgaaaactgcaggccctgctcttctgatgcctggtgaaagaatcttaaagatgagaaggagggacgtacgctctcttttcctgaagctagaaaaagtagatgctcttctgcatcatcaaccacctgtcttagtttgctttctgttgcggtgacagaataccacagactgggtaatttacaaaagaaaaacagaggccgggtgctgtggctcatgcctggaatcccagcactttgggagggcaaggtgggaggatcgcttgagctcaggagtttgagactaacctgggcaacatgaaaaaccccctctctacaaaaaatacaaaaactagccgggcctgtggctgtcagccctggctggatattagaatcacctggtggtgatgagttagctcagtaattagtgagtaaagtcacctaggaagtttggtctgggctcagcatggatagaattcaatgagaatttctggggatggggcccaggcaccagtgttttagtaaagatgcccagatgattccaatgtaccactaaggccgagaaccactggaatagcccggattattctaatgtaccactaaggccgagaaccactggtatagcccagatgattccaatgtaccactaaggccgagaaccactggtatagcccaactaacatatatccaagttattgctgcagagttttactgcttcatttctcaggaaaaccctgacagatgaaagaaggcttgatttagcaagaaagagagtattcagatcaatccaaattcttatgtcatttataactataatccctctgaatatattatttccacaatccccaaaacctttttatttttgtagttaaatttttatttaataggatacaatttttagaaaaaaaaactcttatttttaaaacactccaaatttttctttgcaaaaagacctttgcctggtggttaaattttttaagggaattgatactctttcacctcattagcaaaaaaaaaaaaaaggcttaaatttatttagatctctcaaactttttaagatgataccttttttattgcaacactgtcccaagagtagacatgtctttgacatgggagacctctggtgtctctatgttttctatatagagctgtactgtctgataccatagccactagccatatgtgattctggagtctcactctgtcacccaggatgaagtacagtggtgccatctcagctcactgcaacccccacctaccaggctcaagcgattcttccaccccagcctcctgagtagctgggaccacagactcaggccaccacaccgggctgtttttgtatttttggtagagacggggtttcaccacattgcccaggcttgtcttgaactcctgaactcaagtgatcctcctgcctcagccttccaaagttctgggattataggcatgagccaccgtgcccagccaatatgggactccttaaatttaaatgtctgggggccaggcacggcggctcacacctgtaatcccaacactttgggggcctgaggcaggagggtcacttgagtttaggagttaaagacaagcctgggcaacatggcgaagccccacttctggtaaaaatacaaaaattagccggacatggtggtgcatacctgtagtcccagctactcgggaggctgaggcagcagaattgcttgaacccgggagatagaggttgcagtgacctgagatcgatcacgccactaaattccagcctgggcaacagagcaagactccgtctcaaaaaaaaaaaaaattaaatggctgaggtggcagctcacacctgtaatcccagcactttgggaggcctaggcaggaggattgcttgagctcaggagttcaagaccagcctatgcaacatagtgagacccctatctccacaaaaaaaatttttttttaattaggtgagtgtggtggtgcacacctgtggtcccagctactccaggggctgaggtgagaggatcacttgagcccgggagactgaggctgcagtgagctgtgatcatgccactgcactccagcctgggcgacacagcaggccctgtctctaaataaatgaagtttaaatgaaataaaattagaggctgggcgcggtggctcacgcctgtaatcccagcactttgggaggccgaggtgggtgaagtgcctgaggtcgggagttcgagaccagcctggccagcatggtgaaaccccgtctctactaaaaatactaagattagccgggcatggtggcaggcacctataatcccagctactcgggaagctgaggcaggagaatcgcttgaacccggcaggcagaggttgcagtgagccgagattgcaccactgcactccagcctgggtgacagagcgaggctctgtctcaaaccgctccccgcccaccaaaaaaaaaagaaataaaatttaaaattcagttctttcagaatgaaatgagcacttcacatttcaagtgctcagtagccacatatggctggtgaccaccatattagacgatgcagctacagaatatttccatcattgcagaaagttttattagcactgaattcaagagtgacttttaatttatgcaaccgtatatggttttactcctggactttaatggaaaatggaggcccaccataacctgcagcagatcctatgccaagggggcaggaagtgccattccacttatggtggaaggaggtggtttgggggaggtggaggtgactcctgtgcttactccctgtgagaagaatcaacctctcagggcctgaggggtaaacatttgaggagggaagtgaaagtcctttttttctgaactgttaagcacccccacctagtgctcgtaatattatcattttatgtacaaattggatgcaaagcctaccaccctgtcaaactacagattgcagtgtgatcagttcaactgcaaagattggccaggaaaatcaactctcaccgtggacagcaaggaaccaagtgcatcagcagactctccactcattcctccccgtcactgagaaagagcccagagcggtgtgggtgactgacgtggaacggagctgctctgcgctgagcgtcggcacttggagacctcgattgaatctattcggcaggagagctgaattcagagcagcccacggctcaccccagcaattgtcagtgctggaaaaatcaccaccgttggtgtattcccggccactctgctggacggatggcaggattcccaagtagtgaaggggaaggcggccctcctgcccttcctgcttcctcaggtgggccccgcacctgtgggccggcctgcctgcctgctctgcttgcgagtggctcagaaatgccggctcccaggccgtcgggctgttcccgggatgagacctgctgcctacacatgtcacagcagtgggttctgttcaaaaagtgacatgagagaagagaaaagtctctgctccctcccatgacagtcatggagagtttctaccctctgtcaggaaatccgactctgtgtgtgagtgtgtgtgtgtgtgtgtgttcacatgcatgattgacacttcgctgcctcagcacctcgccgatcctgcatctttcctgtgagttcaaaatgagaatacacccacatttctctactgtcaaaagttttagaactgttcaagtgtgttgttaagtattcagagaaaaggagcttggtcctgggagaactgttgagtggcggggattagcagagggtattgaaaaagaagactgaggcggctgaaggcaatggcagaggtggagagaccctcacgcgtgagctgcagggtgtatgtgcctttggggattcaaaggagtgagacctgctttgactgtggaggaaactgaccacatatcacgcctccactgaaacgttaattagcagagcctgggagaagagctgatatcctcactctggtaggggctgtcagcttgtcaaaaggaaagctctgcttagctcagaagcccaaacctctaaccatggctctagatgtgtaacattcggaatgtcaaggactcagccaatccagatgattacaacagccctaaatatctgatgggaggacaattaggcaagacaatgatgaaaggcgtctggctggcaaagagcaagcaatactatatttgaaatgacacagtcttacatatagaaaatcctaaggaagctactaaattattattggaattaataaataggttcagttgcagggcacaaggttaatatacaaaaatcaactgtatttctatatactagcaatgaacagtacaaatgtaaacttaagaaaacagttctatttataattgcattgaaaagaataaaatactcaggaatgaatgtaacaaaataaatacaaaacttacactctgaaaattacaacatattgttggaagaaatcaaagatgaactaaataaatagacatcccacattatggatgggaagaatcaatattgttaacatggcgatactccccacattaacctacagattcaatataattcctatcaaaatctcagctgagattgtgaagaaaaaaaaaatcccagctgacttttttgacaagctgatcttagaattcatacagaaatgcaagggacccagaatagccaaaacaatcttgaaaaagaagaacaaagttggaagattcacacttctcaatttcaaaagagtacagagttcagaaatcaagacagtgtggaatggacagaaggacagacatacagatgaatggagttgaatggagttgaatggagtgctcagaaataaatcctcacttctatggtcaattgttttttgacaagagtgctaagacctttcaatgggaaagaataatcctttcaacaaattgtacaaagacaactggacgtcctcttccttacaccatacacaaaaaactccaaatggatcataggcctaaatataaaagcacaacctacaaaacttataggagaaaacacaggagaaatcttcatgcctttaggttgggcaaagccttcttagctatgacaccaaaagcacaagtgacaaagaaaacagtagataaattggacttcatcaaagttagaaacttttctgcttcaaaagatgccatcaagaaagtgaaaatggctgggcacagtggctcattacaatgctcaagtaatcccagctcttccggaggtcaaggcaggaggattgcttgagaccaggaggttaaggctgcagtgggccatgatggagccactgcactccagcctgggtaacagagcaagactctgactcaaaaattaaaaataaaagactgggtggggtgactcatgcctgtaatgccaacactttgggaggccaaagtgggtggattgctggagcccaggagttcaagaccagcctgggccacatggtgaaaccctatctcttccaaaaaaatacaaaaagcagcagagcgtgatgtcatgcacctatggtcccagctacactggaagctgaggcaggggaggatgacttgagccctggaggtcaaggctgcggtgagctatgatcgtgacactgcactccagcctggacaacagagagagaccctgtctcaaaaaaaataaaaaatatattaaaataaattaaaaagaaagtgaaaaagccagtccacagactgggagaatatattggcacatcatatagctgataaaggacttgtatccaaaacataaagaactattacaactcaaaaagaaaaataatactactttctgttcaccagacctgaaaaaaaagagaaagacaaatagcagaatcttaaagtagtcaaaaatctgaagagacatttctccaaagaaatatacaagcggccaataagcacatgaaaagacgcgcagcggccacagtggtgcacctgcaatctcagctactcaggaagctgaggtgggaggatcgcttgagcctgggaatttgagatcagcctggacaacataatgagactccatcttaaaaaaaagatactgaaaaatgccccattaggaaaatgcaaattaaaaccaccatgagatatcagttcacattcactcaaaaagtataatcaaaaacacaaataggccgggcgtagtggctcacacctgtaatcccagcactttgggaggccgaggtgggcagatcacctgaggtcaggagttcgagaccagcctggccaacatggtgaaaccccttctctactaaaaatacaaaaattagccgagcatggtggcgggcgcctgtaatcccagctattcaggaggctgagagaggagaatctcttgaaccctggaaggggaggttgcagtgaaccgagatggtgccactgtactccagcctggtcaacagaatgagacaccatcttgataaaaaaaattaaaaaagaaaaaattgtgataacctaaaaggatttggcactcagattgtttagcatctgtctaaattcttgttccacttacgtaaccaagactggatactgtccatgatgaattatcagtgtgtttacacaagaaaggacacagaattccactcaactgatccatactcaaagagaagaccttggccttgcattcagagatcagcaaaaacaatattcactttatgttttaggttagaatatttgatattctaacctaatatggctaataggttttaatatctaatggctaatttgatattctaacctaataaggctggtcttgaactccagacctcaggttatctgcctgccttggcctcccaaagtactggattacaggcgtgagccacggcacccagccaggatctcttttaaagtaagtacaactacaatagaagccctcttctcaatgtgaccagcatcgatgattggtgagtgaatgaagtcaaagtgggaatttaaacagacagagtctcactatgttgcccaggctggtcttgaactcctgggctccagcaatctcctacctcagcttcccaaagtgctgggattataagcatgagccaccacgtctggccagggaaggatttcttaaggtgtaaataatacaactattaaaaaaaaagattaatagatatgacaatattaaaattaataatatctattcaccaaagacatctttttttttttttttttttttttttgagacggagtctcgctctgtcgcccaggctggagtgcagtggcgccatcttggctcactgcaagctccgcctcccgggttcacgccattctcctgcctcagcctcccaagtagctgggactacaggcgcccgccaccgcgcccggctaattttttgtatttttagtagagacggggtttcaccatgttggccaggatggtctcgatttcctgacctcgtgatccacccgcctctgcctcccaaagtgctgggattacaggcgtgagccaccgtgcctggccggtcactttcagataatcttgtaaagctaagaaggttgttttttttgtatttgtttttgtttttgtttttgtttttgttttttgagacagagtcttgctctgttgtccaggctggagtgcagcggcacgatcttggcccactgcaagctccgcctcccgggttcaagcgattctcctgcctcagccttcccagtagttgggatttcaggcgcctgccaccgcacccatctgatttttgtatttttagtagagacggggtttcaccgtgttagccaggctggtctcgatctcctggcctcaggtgactccccacctcagcctcccaaagtgctgggattacaggcatgagccactgcacccggcctatattatcttcacaacaaattttaaaacaaacaagttcttttcaaaacagcaataaatgcttacagttcattttcactttctccaacgtgtacctttatctttgagccccaagaggggtatatatgactatgtacaacctaaaacaacacagcagaaaccatggctacttctaagatcagtacgagctccaagacgtgactgattcaatacaatcaactcaagtggggaagatgcaacaaaacacgatagcatttactcatggtgttgagcagcgagagatgggaactggggaggcaggggagaagccagggagccacctggaggtctggtttctggtgactagccagtgacaaagtcagatttcatcgaggggtagcaacagctggagccattgaggacatgacagccttagagacaaactgtgtgacaatttccccctcttccctccttcttcccaactcagttcaccctccgccctccacatgaatgagcaagacaggagggagacagaatgagaacgtgactgttcctcttccgtagcctcctctcacacaccctgccctcgccctcctcccgtccctccacacccaaccccttcccctgtggtgccccttcttttccccgaccctctgttgctgtcactccaatccacccacatagctcccttcccgcgatgatgacaacttcttgtatccaatgggcaacactgtgatgcccccacctgaccacccttcaaaggaggatttgtcgtcccagctgcttgagaaccatggaactctgggttctgccagcccaaggtgaaaattccccaagggaaggatggatgctggacacggtcaccatatgtccaccagttagaatcaactcctagagatgggatttccggtcaaatggttagatatgcatggaaatcggactttagtttcagcatttggccccagtctgctaactgggcttggtttagtcttgacctttggaaggccaaagagcctacttccatgttatttatgtttatggcctccacgaactgtgactgatcaatgattctgtgatcactcttctctcttactagcataaaaatgtgggccaggcacggtgactcattcctgtaatcccatcactttgggaggccgagatgggtggatcacctgaggtcaggagttaaagatcagcctgaccaacttggtgaaaccccgtctctactaaaaatacaaacattagctgggcatggtggcacatgcctgtaatcccagctactcaggaggctgagacaagagaattgcttgaacctgggaggcagaggttgcagtgagccaagatcgcaccactgcactccaggctgggtgacagagcgagactccatctcaaaaaaaataaaaaattttaaaaagtcagtaatactcaaagcatgccattttgatttagtattaatatttcaatattcacttccttttttttttctttttttgagacagggtctcactctgttacccagactggagcgcaatgaggccatcatagcccactgcaacctcaacttccttagctcaagggattcttctgcctcagcctcccaagtagctgggactatgggcacctgccatcacacctggctaatttttaaattttttttgtaaagacagtgtcttgctatgttccccaggctggtctcaaactcccggcctcaagcaatcctctcaccttggcctctcaaagtgctgggattacagacgtgcgctgcatgatccccgtgagccactgcacccggccctcaatattcactttcagatattcacaccttgtctagggtggcctacagccactgcccataaatgcagaagtataaaggtctagccatctcagcccaactcaagaagactctgaagggccatatttgtggcagagctcctcgggggttggccaaggctgtcattggccaacatcacagcttagcttctccctctgccctctcctgtttctgcctcctctcttctataggtgctgatcgcaagggcactccttaataaacatcctgcccatcaaactccatctcagagcctgcagcacagcccttactatctgaaaagtcatttggccttgatgctaagatgccttccacaggtgtccagcattttggcttccctgggccacattggaagaagaagaattgtcttgagccacacataaaatacactaatgctgctgggtgcagtggctcacgcataatcccagcactttgggaggccgaggcaggtggatcacctgaggtcaggagttcaagaccagcctggccaacatggagaaaccctgtctctactaaaaaataaatatgaaaattagctgggcatggtggtacatgcctgtagtcccagctactcaggaggctgaggtgggaagattgctggaacctgggaggcggaggctagagtgagccgagatcaccccactctactccagactgggcgacagagtgagactctgtctccaaaaaaaaaaaaaaaaaggtccatgcataattataattttcaagatatccgccaccatagagaagcaaaaatgtcctcacattcaaagggttagacagtgctcttttttttttttttttttttgagatggagtcttgctctgtccccaggctggagtgcagtggtgcaatctcagctcactgcaacctccccctcccgcgttcaagtgattctcctgcctcagcctcccgagtagctgggactacaggcgtgtgccaccacactcagctaatttttgtatttttagtagagacggggtttcaccatgttggccagcatggtctcgatctcttaaccacgtgatccacccgcctcagcctcccaaagttctgggattacagacacgagccaccgcgcctggcctagacattgctcttagactgtagagatgaggtttcaccatgttggccaggctggtcttgaactcctgctcatgtgatccacctgccttggcctcccaaagttctgggattacaggcataagtcactgcacctggtcctcttcaccttttaatcctcattcttctctttggactgtttcctgctgtaggatacacttacttaaaatcagctggctggccacagtggtgcacacctgtagtcccagctaccaggatggccgaggcaggaggatctgttgagccgaggagttcaaggctgtagtgcgctgtggtcacacctgtgaatacccactgcactccagcatgggcaacatagcgagaccctgtctccaaaaaataaataaattagctgatcactccttggagcatgtagtgaattaggaattcaccaatggaagaaacacgtgtgagtatacgatggcgacacctggtggtaggatatgcaataacatcgtgaacctcccttaatggtggattcctggcttattgttggaataaaatgtaattacatggaaattgtaagagccattctaaaaggttagcaacaacaagaaaaaggttgtctgcatgaacttgcatgtgtgtgtgtctattcttgtgcattaaggacagacaataatccaagacacagttaatgaagatgagagcctgatcaagaacctgtcgttcactctgctgcttactgttatgctgaccttgtgcaagacacttcactgctttgggctttggctttctcatctttagagtaggaagatttaagaatccccacttagttcaataaatagtataagtgaaaactgttttgtgaattgcgtgaatatgttatactacgttaattattatactattagctattattataataaagatcatcgttggcaggacacagtggctcatccctgtaataccagcactttgggaggccaaggcagccggatcagttgaggtcaagagttcgagaccagcctggccaacatgatgaaaccctgtctctactaaaaatacaaaaattagccaggcatggtggtgcgagcctgtaatcccagctactcggaggctgaggcaggagaatcatttgaacccaggaggccgaggttgcagtgagccgagatcgcgccactgcactccagcctggatgacagagcaagactccatctcaaaaaaaaaaaaaaaagaaaactgttacaaagttagctctctgctacaaatttcctgtcaaggaatgttaatattgcttgaagatgagagcgcattagtctggactttgaaccttgtaatagtcccttttactcagggataactgcttaaaactgcaacgtgtccaatctatgagcgtcaaaacagcaaccgggtgcagggttctcagccaggggcaattttgtccccaggggacatttagaaatgtctggagatatttttggttgtcacgactagggggaagagtgctactggcatctagtgagtagagtccagggacgctgctacacatcctacaaggcacagacagcacccccaccacaaagaattatccggccccacatgccaaaagtgctgaggttgagaaactggtctagcgtaacagaagggagaaagtagacctttttccctactgtcctaaccaccattaacagcaaccacaaagatgggatggtgggtcatcaatgtgaaattctccaacatatatgtgcaaaagagctcaagaaatgtattaagtagcatcatacaatgccattgttatctactatgtgtaaaccgtctcaacatgggcacaactggtcttgtttttccctcctctttttacaaagaaaatgaacctgacctgaatagaacttttgctctattcagacatcaaaataaaaactagcggtaactattaaatgtgtagttacttgtggaattaagactaagagttaaaagggagtgagtatactttgtaatgaccacatgctctgatagtgtatagtagtgccattttttcacttttcatttaatatttttcagacaaggtctcactttgtcaccaaggctggagtgcagtggcacaatcacagttcactgtagcctcaaccttccaggctcaaacaatcctcccacctcagcctcccaagtagctgggactacaagtgcatgccaccatgcccggcaattttttttttaagatggaatgccattatgttatccagctggtctcaaattcctgcactcaagcagtccacccacctcagcctcccaaagtcctgggattacatgtgtaagccactgcacccagctgagtactgccatttttaaaaatgggacaagaacatttacaaatacatttaaaggctgggtgtggtggctcacacctgtaatcccagcactttgggaggccgaggtgggtggatcaccttgaagtcaggagtttgagatcagcctagccagcatggtgaaaccatgtctctactaaaaatccaaaaattaaccggtgtggtggtgcatgcctgtaatcccagctactcgggaggctgaggtgggaggatcgcttgaacccaggagacagaggttgcggtgagccgagatggcaccactgcactccagcctgggcgacagagcgagaccccctctcaaaaaaaacaaaaaacaaaaaaacaagcacacacatttaaaaatgtgtgagcaagcacacacatttaaaaatgtgtgagcaagcacacagaaaaaaagctttttaaaaaacctttttagtaattatattagtgatggtaatattagtattgcagctccgacactgttatgagtaatgcggacacatcaaatgcgcaagatgaggtattctgattccattctagattttggttttgagaatcatattttcaacgtggaagaatgtgtatacaggattctcaagatgtagaggttaggtaaaattccttgctgttctgaatctgaatgtaaagtatcagtgtgaatgcatgaggtattttctattctattctcttcatgtgtctatatatgcaaaatcttcactgagaaggcccaaaagcaaagcaacgaccagcacagtagcagccagcatctttatgcccagagtaccgtcttcaaataccatttcccactaaaagaaacaaatgcttcatgaagaaatgactgattcccagtttggggcagaaaatatacattttgacctttgtcatatcatctagtcacatcagatagcaacaaaactaccgaagactactagggccatgtaagaaggattcaggagccagttggaaaaggcatccacttactgaagatgacacaatttatgcttcaataattccaagggactgaaaatgatcaaatatgtttaaatccctaagttcttaattatattcaaacatttttaatcatcacatttggaggatgctagggaaccaattctcttcccgggagaggagggtgggggacccattccttatcttagaaaacttacgagagaaaagaatctagtacttttcccaactttcctacatggattgtaccactgggtaacctaatggtagatgagaggaggcatctctttatgaaagtattgcaactaatagaccggcgggcgcgttggctcaagcttgtaatcccagcactttgggaggctgaggtgggtggatcacgaggtcaggagatcgaaaccatcctagccaacatggtgaaaccccgtctctactaaaaatacaaaaattagccaggtttggtggcacacacctgtagtcccaggtactcgggaggctgaggcaggagaatcgcttgaacccaggagttggaggtgcagtgagctgagatcatgccactgcaatccagcctagcaacagagcgagactccatctcaaaaaaaaaaaaaaaaaaaaaggtattgcaactaacaaatgaaaaaaaaagcggtagaattagagtattacaattttgtaattgtcagtggattaatggctttaggcatcaggcatccatgactattaacatagcaacagagttgacctgcgttttgtgcttcctgattcaagatccagtagtgacttagtcttgccatagagtctgaacctaagtctcatcataccttgggatccagctgctacatcgtaggaaatccagaacacattgaattccaccgagaatacttcatcagcaacatccagattgtgggaaatttcacaggtcaaaggattcaggtttttcaacagataaattgtcagaataagaaagagaggggaaacttgtagcttcggagacttaaaatcataactaattttcaaaaaatagagatggggtcttgttatggtgctcaggctggtctcccacctctgcctcagcctcccaaagtgttgagattacaggcatgagccaccacgcccagccacgacttttttaactggacaaccatagagtcccaggtgttcactataaagaaacacgaccaagtgattgtcttcgtggtttcttggcggcggtggtggttgggacgtgataggggtggggcccgtggatggtcttctcagtggcttgcaaagttctattccttgacctggatggtagttacaagggtgtttgccttcattacgctatacattcatttttgtatgattttctgtatttatgttttattttccaaaaaaaaaaagctttaaaagagtataaagaaagtagatggcagaaatttgtggaatcttcccccagcaacataaaaacgcggtgggtttttgtaacttggtttttacactttacaattaatattgtaatgagaaatactcgtgtggaccactagggcgcacaatttgttgcccgcagcatctgcggcactggcactgatgaaagggggatgctaaatgcttcagtaacgccacctgagtctcgggatgaagcaacattattcatcgccctttgatcatgagctacatatgtgagtgccaatgctggcgaatcgtatttggaaagtcgggtccaacatgtgatgtgtacatacagggtatacactgaaaataccgtagttttatcctcttttaagataagcttcaatttatttgagttattagaacaaagcctcataaaccacggtaaaaagaaccttaaaacttttttttttatttttgaggaagtcttgctctgttgcccaggctggagtgcaatggcacaatcttggctcactgcaagctccatctcctgggttcaagcgattctcctgcctcagcctcctgagtagctgggattacaggtgcccgccaccacgtccagctgatttttgtatttttagtagagacaggggtttcaccatgttggtcaggctggtctcgaacccctgacttcaagtgatctgcctgccttggcctcccaaagtgctaggattacaggcatgagccacagtgctcagcccaaaaacctcaagacttagtgtgtggagaatggaggtgaaaagtttttgtggtggtctcctaatgagacgatagccccctggcggagggagagaaacacgtgagagctatttggagcctccctgaaaggtgtcactgggctatggatggactgagaaccacacagcgacgggccagccttcgagggccaacacagagtgagagacggcctctgcagggcccaggctggggaggggtggtgaggccagtcacgactagtaatctaagagccgtctttccttacctgtggtgtggaaagggctgcgggtcacagaatcttagtgatacgagcttaggcgaggctcaacggccctacctctcaggtgagaaagcagctctcctgtaatcgttatcttttctcaaaggggaagaacaacttcttcctgttaataaatcacagacctcagatgctttgtattgctgaggaaacaaaacgtttatgaattgttcacaggctgagaaaataagatgctttgagtttttggttttttctacaaggctgcaataaataacacagcagtaaatcctaacctttagctctgattggtattatttcattttggtgcctttccagccggcccaaaagtgtgatgctgtgatacacacagtatgtgtgtatgtgtgtatacacatgactattttgtgagatttcgcgtactagttcattagtggcgccctggaatcacagatccttcctgctgcggtgatagcatgtgggtggtgccgaggtggactgctgcttgatggtgaagaaagaaaagaggacaggaggacccgccaggaccacatgtggagagctgcagcgaaagaatcctcgctcggtggacaccatggctttttgctaagccctggttctctctatggaccccatgcctcatctccagagccaaaacccagcctttctcattcaaggacactccccagagctttgggaacacatttcattctggctctgttaagtacccccatagggtcccgaaagtccaggctgcttcttgcccctgccgcctcaggtcccagaggcccactgctgcgtccaggacgcctcctccaccacgtcctctcccaaagcttatgcagcagttaagcaaaggggccctggcctctacagcaccgaggcagcctcctagttcagccactctcatgtgagtgtggacaaattatttaacctccctaagcctcccttctctcttccattaaatatggatgataaggataataaatattaacctcataaggttgttgtgagagttaaatgagaaaagatatataaaacttaggccgggtgtggtggctcacgcttgtaatcccagcccttggggagtctgaggcgggcagatcactgaggtcgggagttcgagaccagcccaaccatggtgaaaccccgtctctactaaaaatacaaaattagccaggagtggtggctcatgcctgtaatcccagctactagaggggctgaggcaagagaatcttttgaacctgggagggggaggttgcagtgagccgagattgcattattgcactgcagcctggacaacaagagcgaaactccatctcaaaaaaaaaaaaaaaaagatatataaaacttagtgtcattcctggcctgtaaatggtaagtaaaatgtagctctcacctttactccaggtttcagaaatgctgttcctctcaacagagaggtggtggattctccacaaatgctgaggaatgaatggatggatgagagaatgcagtgaccacttcccatggatggatgagagaatgcagtgaccacttcccaatgatgaagattatggcaaaaattgattttaaactcctacaagatagaatccatgatttaattctttttatttttttctttaagacagagtctcactcattgcccaggctggagtgcagtggcgtggttacaactcacggcaccctcaacctccccgggctcaggtgatcttcccacatcagcctcctgagtagctgggactacaggtgcatgccatcacacttagctaatttttctattttttttttaagagatggcgttttgccatgttgcccaggctggtctccaactcttgggctcaagcaatcctcctgccttggcctcccaaagtgtacagtcatgtgtcacttaagaatggagatacattctggaaaatgcgtcattcagcgatttcgtagttgtgtgaacatcacagagtgtacttacacacacctagatggtacagcctcctactacacacctagtctgtatagtgtagcctattgctcctaggctacaaacccgtacagcatgttactttaccgaatactgtaggcaatcgtaacacaatggtaagtatctgtgtatctaaatatatctgaacatagagaaggtacagtaaaaatacagtattataatcttatgggattctaagattataatcttataataatataatcttgtatatttggtccatccttgacaggaacattgctatgtggcatatgactgtatagctcttcgaaccaaaataaagcaaaaagatgactcccaaaaaatagattatgaggccgcacgtggtggctcacgcctgtaatcccaacactttgggaggccaaggtgggcagatcacttgaggtcaggagttcaagaccaacctggccaacacagcgaaaccccatctctaccaaaaatacaaaaattagccgggcatagttggtgctcgcctgtaatcccagtgactcgggaggctgaggcaggagaactgcttgaacccaggaggtggaggttgcagtgagacaagatcgtgccgctgcactccagcctgggcaacagggcgagactccatctccaaacaaaacaaaacaaaattatgaagagactacgcttagattagggactgggatttaacacaggttcaatcttcctagagtacatctttaataaagtatacacagggaacagtgcccaaatcataagtgtacagctagatgaccttttacaaagtgagcacgcatctgcgatcaacacccacagaaagaacattcccggcgcccagcactgtggccctcccgttcactgaccccgccttccaacttctggggcatagatttttgtttttgaatttcggacttgtttttgtttttgttttttcaggttttctttgttttgttttgttttgttttcctgagacagagtctcattctgtcacccaggctggagtgcaatggtgtaatcttggctcactgcaacctctgcctcccagattcaagcgattctcctgcctcctgggcagaggtagaaaaaaagtttcaaaaatcatgaattcatattaatattcaaattaggacatttacaatctaggcactaaggataggcattgctagtaggtgtcattgctttttttttttttcttaagatgaagtctcactctgtcgcccaggctggagtgcaatggcgcaatctcggctcactgcaacctcctggcctcccaggatcaagcgattctcctgcctcagcctcccaagtagctgggatgacaggcgcccgccaccatgcccggctaatttttgtgtttttagtagagttggggtttcaccatgttagccaggctggtctccaactcctaacctcaagggatccgcctgccacaacctcccaaagtgctgggattacaggcgtaagccacctcgcccggcctgttttttaactttggataaatggtaacctacagtgtacacatttttctgtctcctttcttttcattcaaccttctatttctgagattcacccaagttgtcccattaagttctagacttaaatattatatgtgttgtagggttattatggacaaataacacagcagaatggaaaagaacatgaaagtgagacccctgcaacccattaatgtgtgtttcatttaatgacggtaactctaccgaaaaagaacaagaagcgatgacacctggccgggcgcggtggctcacacctgtaatctcagcactttgggaggttaaggcgagcagatcacttgaggtcaggagttcaagaccagcctggccaacatggtgaaactccatctctaccaaaaaatacgaaaattagccgggagtggtggagggcagctgtaatcccagctactcgggaggcagaggcaagagaatctcttgaacccgggaggccaggagtttgcagtgagctgagattgcgccacagcactccagcctgggtgacagagtgagactccatctcgagaaaaaaaaaaaagcaatgacacctactagcaatgactattcttagtgcctagattgtaaatatcctaatttgaatataaatatgaattcatgatttttgaaacttttttctacctctgcccactgaaagagcctagacgaaatggctctcagtagcagtgagctctcctggggcctggttcttgggttccaaatactatatccactaggagaggccgggtgtggtggctcacgcctgtaatcccagcactgcaggaggctgaggtgggcagatcacgaagtcaggagtttgagaccaacctggccaacatggtgaaaccccgtctctactaaagatacaaaaaattggcgaggcatggtggtgcaggcctgtaatcccagctacttgggagactgaggcaggagaatcacttgaatgcgggaggcggaggttgcagtgagccgagatcacactccagcctgggtgaccgggtgagactccatctcaaaaaaaaaaaaaaaaggaaaaaagaaaagaaaatgtacaagatgttccagggatagcctttgtgtcagaaagtaagagagcttgggtccataaggagccactggggggaaacaacaagtttttaaaatttaaataaatagaaaaaaaaaggaaggaaggaaactattaaagacctcttgaatcttatcaaagaaggaaggaaactattaaagacctcttgagtcttatcaaagatacaggaactaattggatgaagtaaaaaatggaataatttcagcatcaaaaagaataatcactataatggatggaaaacaacaaaattataaaatttatataaaatatacataaaaatttatattaaatttatatacaatgtaatgatatatcattatatcaagtcctctccacccccatgaaaaatccctcattgttgtctttggaggttgctgagggaccaacacattatgctgaaaattggcaaatgaaaggagtgagtcaagcatttatcctgtgtcttcctatatactctgcatctttctttgttttcttttcttttctttctaagttcttttctttctttcttctttctttttctttctttcttctttttctttctctcccttgcttgctccccttccttccttcctcccttccttccttctttctctctttttctttctttcctctttttagagagatggggtcttattatgttgcccaggctggtctcaagctcctggcttcaagtgattctcccacctcagcctccaaaacactgggattacaggcatgagccacatgcccaggagtctgtgtttcaaagtaaccaaagagttaatgaaggaaaggtctttatttttatttacttattttttttgagacggagtctcactttgttgcccaggctggagtgcaatggcgcgatcttggctcactggaacctctgcctcccgggttcacgcgattctcctgcctcagcttcccgagtagctgggattacaggcatgcaccgccatgcccagctaattttgtatttttagtacagacgagatttctccatgttggtcaggctgatcttgaactcctgacctcaggtgatctacccgcctcagcctcccaaagtgctggggttacaggcatgagccaccatgcccagccaggaaagttctttttaaatgaaaatccagttagtaaatccagaagtaatggtagcaactaatgaaataatgtatttaggcaacaatcatcaacagctactaaaacatcaggcaaaaggttatagagaaactgtaatgggggatcagactgacaccacctcaacccactgaccagtttttgagagtgaggaacaggaagtagatggcacctctatgacatgtgctcaccaacaaaattagatctgaatggaatcaagcttctagcgctgcctaccagtttatgggaaatatggacaatagaggaaaaacacaatgacacaacagaaatcagtcagctgaatccgacgtagggaaattctacaggcatgacctggtttcttcaaaaataaatgacatggggcaaggcatggtggctcacgcctgtaatctcagcactttgggaggcgaggtgggcgaatcacctgaggtcaggagttcgagaccagtctagccaacatggtgaaaccccatctctactaaaaatacaaaaattagccaggcgtgatgggcacctgtaattccagctactcaggaggctgaggcaggagaatcacttgaacccgggagatggaggttgcagtgagccgagattgtgccactgctctccagcctggacaacagagcaagactctgtctcaaaaataaataaataaataaatgacattggggaatggcaggtaagaggagtgattaaaataggcttaaaaggctgggtgcagtggctcgcacctgtaatcccagcactttgggaggctgaggtgggtggatcacctgaggtcaggagttggagaccagcctggccaacatggtaaaaccccatctctactaaaaatacaaaaatcagccgggtatggtagcacatgcctataatcccagctactcaggaggctgaggaaggagaatcacttgaacccaggaggcagaggttgcagtgagccgagatcgtgccactgcactccaacctgggcaacagagacttcatctcaaattaaaataaaataaaataggcttaaaagaggctgcaaccaaagccactttgtggcacttatctgggtcctaatttgaatgaagcaattataaaaagacattttagagatgtacagggaaatgtgaacatattggtaattttattagatataataataacatcgaagttatttctctctctctctctttttttttttgagacagagccttgctcttgttgcccaggctggagtgcaatggcatgatctctgctcactgcaacctctgcctgctgggttcaagcgattctcctgcctcagcctcctgagtagctgggattacaggtgcacaccaccacgcccggctaatttttttttttttttttttttttgagacggagtctcggtctgtcgccccagctggagtgcagtggcgcgatctcggctcactgcaagctcctcctcccaggttcacaccattctcctgcctcagcctcccgagtagctaggactacaggcgccagctaccacgcctgtctaattttctgtatttttagtaaagacggggtttcaccttgttagccaggatggtctcgatctcctgacctcatgatccggctgcctcggcctcccaaagtgctgggattacagacgtgagccaccgcacccggcctcatttttgtatttttagtagagacggggtttcaccatgttggtcaggctggtctcgaactcctgacctcatccacccgccttggcctcccaaagtgctgggattacaggcgtcagccaccacgcctggcctctctctctctttttaaattatttttttgtagagacaggatctcatctctctatgttggccaggctggtctcaaactcgtggcctcaggcaaccctcccttctcagcctcgcaaagcgctgggatttgggattacaggcaggagcaacagtgcccagacttaagttattgtttttcatgcccatatatctcagagatagctactaaactatttatggtaaagtaatacaatgtatattatttgctttaaaatattctagcaaaaaaaagagtggaggggaacagatgaaataaggtgagccaaacgttgggtgttgaggctggatcaagaatgtttgagcactcactatgttatttcctttatcaggggcatttttgaaattttccaaaataaaaaaaaaattaaattttatcccacatttaaatgtatgcaactggcgtaaactacattaaaatctcaggaattttgacgaacggaaatgaggccagagtaggaggaacacagcagagagggaggtttggtggcaaagacgatggatgcgctgagtttgaaagatgtcaagtcgaagcgcctgtgagaggcgcggggagagtcgccgggcagggagtttggcagcagcgtctggcgttcaggaaaggggatgaggccacaggctgacgccggaagccacgggcctgtggatggcggctgcagctttgggaagggtgggcagtgtgaaaaggaaggtcagggccctggcaaagcctcgaggaggaaaagctgacaaagaaaagctcaactaagggccgggcgtggagcctcacgactgtaatccacgccctttgggaggccgaggcgggtggatcacctaaggtccagagtttgagaccagcctgcccaaaatggtgaaaccctgttgctctactaaaaatacaaaaattagccgggtgtggtggcggacgcctgtaatcccagctactcgggagactgaggcaggagaatcgcttgaacccaggaggcggaggttgcagtgaaccgagatggcaccacagccctcctgcctggacgacagagcgagacgttgtctcaaaaaattttttttaaaaagtcagctacagcctggagagcaaccaagaagagtaagaaaaaatggtgtcatcaaagtttagggacgtgagtgtttcaagaaagaaataaacccaaattgtcagatagggttggtcaaaataaagacttgaaatgggccttggagaattcttctgtttttgaaacacatactgaaatattttgggataaatgatatgctatctggagttttcattaaacttatccagggtgaggtgagagggagcaggtggagatggtggcaacaagattggctgtgagttgtgactgtggacaccgggcatggaacacgtgggaattcactgcactgttccttccacctataggtatgtttgaaatttcccataatgaagttctttttttatgtttctataacaatcagtagcctgtggatttctcatcacggaaaccaccagtaacctctgcgtgggtagtttgggtggcctatggaggcagaggccaggctgaacggatgaaggagtaagtagaggtcaggttctcaagacagtgaggaaggcaacagacaacttgttcaagaaatttaactctggaggggagaaggggcaaggaagtagacaggggaggatgtgaggttgaaagatggtattttatttttcacactggagagactagaacttggttatagcctgataaggcgagccagcagacaggaaagtttttgaaaaaggagggagcccgagaaagtaggaagcgatgggagggaggttccagaagaagaaactggccttaaatttgataacagctcttcctctggtacagaagaaagtggtcaaggaggccgaggtggaaggataggttgagaccaggagtttgagaccagcctgcaccatagcaagacactgtctctacacaagcaaaatacaaactggttttgcgtgatgtagttccagctacttgggaggctgaggtgggaggattccttgagcccaggagtttgaggctgcagtgagctatgattgcaccactgcactccagcctgggtgaaagagggagaccctgtctcaaaaaaaaaagaaagaaagaaagtgagtgagggcacaggtagtcaaaggtgagtgatggggcatactcctggcagatggcttttcttttccctcttgactggatggtgaggacatccactaagagtggaagtgaggccggccatggtggctcatgcctgtaatcccaacactttgggaggccaaggcagatgaatcacttgaggtcaggagttcgagaccagcctagccagcatagtgaaacctcatctctactaaaaatacaaaaattagctgggtgtggtggcacacgcctgtaatcccagctacttgggaggctgaggcatgagaatcgcttagacccaggaggtggaggttgcagcgaaccgagatcacaccactgcactccagcctgggtgacggagggagactccatctcaaaaaaaaaaaatggagtagaggcaaagaggcctgaggccagaaacagtggagccaggtgtggtggcacaggcctgtagtcccagtgactcaggaggccaacgtgagaggatcacttgagcccaggagtttgcaaccagcctgagcaacatgatgagactgtctctacaaattttttttttttttttatggagtcttgctctgtcgcccaggctggagtgtaatggcatgatcttggctcactgcaacctccgcctcccaggttcaagagattttcctgcctcagcttcccgagtagctgagattacaggcacctgccaccacgcccagccaatttttgtatttttagtagagatggggtttcaccatgtggaccaggctggtctcaaactcccaacctcatgatccacccaccgcggcctcccaaaatgctgggattacaggcgtgagccaccacgcctggccaagaaatttttttaaactacccacgtgtggtggtgcatacctgtggtcccagccagtcagaaagctgaggtgagaggattgcttgagcccaggaattcaaggtttcagtgagctatgatcgggttactgcacactccagcctaggcaacagaacaagaccttgtcaaaaaaacaaaaaacaaaaaacaaacaaacaaaaaaaaacagcccaggcatggtggctcacgcctgtaatcccaacacttcgggaggctgagatgggaggctcacttgaggccaggtatggtggcacacacctgtaattccagctactcgggaagctgaggcaggagaatcgcttgaacccaggaggtggaggctgcagtgagccaagatcgcaccattgcactccatcctgagtgatagagcaagactctgactcaaaaagaaaaatttaaaaattaagaaaaaaaaaggagaatatttgaaaatgagagagttcactagaaaacactgtgaagcagtgtcgaggatccaaatgacatgggtggacatgaaaacgacatgccccgttttgtgaaattttccagcaatactcagcagcctggttctgagctcacgagaaggtccaggctcattccactgatggaaggttaccaaggatgtggataggacaattgaacaagagagtcaagaactgtagttcttcaatgttgccgaacaaattacatccaaatttagcagcttaaaacaacaagcatttatcatcgcacacagtctctgagggttgggaatcctggagcagctaagctggacagctcctgctcaaggtctgtcacagggatagggtcctcttcaggcttgccggggtggaggaccagctcccaagctcactggcatggttgtcagcaggctcaggtttattgctgattactggcaggaggccttgccactgggctctccataggactgcttacaacatggtaccgagcttctcccagagtgaaaatctaacggagaaaaagagagagcgccagcctaagatggtggcatttcatagcacaacacatcatctcaaaacttttacttgcctttgcccatcgcccatcagcttcctgaaaggggggactgagtgtgtctgtcttgtccactgctgtacccttagaggagtgctaggcacatagcagacgatcgagtttttttttctttatctcggctcactgcaacctctacgtcctgggttcaagtgattctcctgcctcagcctcataagtagctgggaatacaggtgcatgccaccacgcccagctaatttttgtatttttagtagagacggggtttcaccatgttggccaggctggtctcaaactcctgaccttgtgatccacctacctcggcctcccaaagtgttgggattataggcgtgagccactgggacttgttgttgctgttttttttttttgttgttgttgttgtttttgagacagggtctcactctgttgcccaggctggagtgcagaggcatgatcatagctcactgctgcctcaaactcctgggctcaagcgatcctcccacctcagcctcctgagtagctgggattacaggtgtgaaccctgaaaatctgagacaggttccagtaaacttagaaagtttattttgccaaggttgaggatgcacacccgtgacacagcctcttaaactgaaccttgggagttcctgacaccgtgtggccaaggtggtagggggagagtttggttttctacattttaggagacatgagacctcaatcaatatgtgtaagatgaacatcggttcagtctggaaaggctggacaaagcgggacaactccaagcaaggaggggcttcaagtcacagtagatgggagacaaacagttgcattcttctgagtttctgatgagcctctccaaaggaggcaatcagatatgcatctatctcagtgagcagaggggtgactttgaatagaatagggggcaggttgccctgcttgacttttccctttagcttagtcattttgggaccacgagatgtattttcccttcacacaggcatgagccattgtgcccagctctaaaatacatctttaagtaaatgaatgaaatgagtgagtgaaacccaccggagaaaactgtagctacactcagtgaaaaactttctttttgagggaggggcagatcttccatgggctggattataaatttttataggtgaccgggtgcagtggctcacatctgtaatcctggcagtttgtgaggccgacacaggcatttcacttgaggccaggagtttgagaccagcctggacaacatggggaaaccctgtctctactaaaaatacaaaaattagccaggcgtggtggcgcgcctgtggtcccagctacccaggaggcggaggtggtgtcagaggtgtttgaaccagagcaactgcatcttgaataggggctgcgtaaaatgaggctgagacctactgggctgcatccccagcctgttaggcattctaagtcacaggatgagataggaggttggcaaaaaatacaagtcatatgctggccgggcgcagtggctcacacctgtaatcccagcactttgggaggccaaggcaagcggatcacctgaggttgggagttcgagaccagcctgaccaacatggtgaaaccctgtctctactaaaatgcaaaaaattagctgggtgtggtggtcgcgcctgtagtcccagctactcaggaggctgaggcaggataattgcttgaaccctggaggcggaggttgcagtgagccgacatcccaccactgcactccagcctgggtgacagagcaagactctgtctcaaaaaaaaaaaaaaaaaagatacaggtcataaagaccttgctgataaaacaagttgcagtaagaagccggccaaatcccaccgaacccaagatggccatgagagtgacctctggtcgtcctcactgctacactcctgttagctccaagacagtttacaaatgccacggcaacatcaggaagttaccctctgtggtctaaaaaggggaagcatgaataatccacccctcgtttagcatatcatcaagaaataacaatgacaatgggcaacccgcagccctcgcggctgctctctctctggagtagccattcttttattcctttacttttcctgataaacttgctttcactttacagacttgccctgaattatttgttgcacgagatcaaagaaccctctcttggggtctgggtcgggaccgcttttcagtaacatctttctggtgatcacggaagagactatagtgtggaaacacccgacccaaaggctaactttgagcccggtgtggtggcacgcacctgtaatcccagctactcaggaggctgaggcaggagaatcgcttgaaccccagcgacagaggttgcagtgagctgagatcgcaccactgcactccagcctgagcgacagagcaagactctgtctcaaaaacaacaacaacaaacaacaacaacaaaaaaccaaaggctaactttgggtaagtgatggggttcagtaacatctttctggcaaatcatggaagggacgatactgaagaaacccccgacccaaaggaaatagactggagcactgattggccgactttgggtaagtggtggagtactctggtaaagggtgggatgggattagaggcccaatttaggggaattagagtctctcctaagacagagtgggatagaggcccctcttaataaaaggcaaggacacggtgaaaccccgtctctactaaaaatacaaaaaattagccgggcgtggtggcaggtgcctgtaattccagctactcaggaggcaggagaatcgcttgaacccaggaagcagaagttgcagtgagccgagattgcaccactgcactccagcctgggcaacaaaagcaaaattcggcctccaaaaaacaaaaaaaaaacaaaaggcaaggacgcttgaccgaccttgggttagaagcccaacttaggagggttggagtcccttccaagatttagggggttagaggcccctctcagtaaagtccctttcagctaagaacgggtttggcactatgggatgttaactgctgttctctttagattaatctgccttgcactctttgctgatggctgtgggtgacagcattaagcgtgtacaggatcgtgggacatagggagcttttttctccctaaaaggggaaacttgagagctgatgggacttctggaaaagatcccttcacgaccgacaagcagccgcctggacttttcagtgtcactgcaatgggtgggtctttctctggcctccccgagcacctcaccttcctcaccttcctcaccttccccaccctgcctcaggcaatgcattcctctctctctgtgcaaatgggttaaatggtaaaaatcactgtttatctcctctatgaagttttgatgaatggaagaaaggatttgcgaggctaatcttaaactgtagtgaatctggtgtgctttgcctgtctttctgtgttctgtgatggagaggagtatcttaggacagaatgagggcctaggacacctataagcccgctgttcagagacggcccagcacactggtcagttaaaaacttcggccgggtgcggtggctcacgcctgtaatcccagcactttgggaggctgaggcgggcaaatcacaaggtcaggagttcgagaccagcctgaccaacatggtgaaactccgtctctactaaaaatacaaaaattagctgggcgtggtggtgagcgcctgtaatcccagctactcaggaggctgaggcaggagaaccgcttgaattcaggagatggaggttgcagtgagccgagatcacgccgctgcactccagcctgggcgacagagtgggattccgtctcaaaacaaacaaacaaacaaaaactttgctgcaggtccctgaaaaaaactggatgaggttcccttcttgtcttgtatgtccttgggagctcgaccttgtaaccatgtggctgtgctttctctttccacagtggcagcctgggttcagggtccaattcctggcttgaggaatgagtcctttatcttctgtctgtctgcgtatttatgtgtgtcgtgtgtgtgacgtttacatataaaagagcttgggttgattggcttaaaaacaagtgcttaaatcaaatattttgacagaaaagtataaagtataatgccttttagttcatgtgacttaagtaatctttgggaaacagttttaaagattattggtaaaataaaaatatcttcaaaaatgtaaatatttggtctaacttatgcaggtcagatgtttgctaaatgctttgaggttataaactgcttctttgacttttggaaattgttcagtttacctaccttgctgtgtatgaacatattggctaaagttgggtattattcagtttttgcataaattaaacattggaaaaaaacacaacaggtttttcctgaagcaaaaatctgcttatgatctgctctttaacaaaaattgtaaagggttataaaaagtttatgagaatcttaccttagggtcaaacattaaaattgggtaaatgtgtctatagggttttattaagaattgggtttggctgggtgcagtgaatcacgcctgtaatcccaacactttgagaagccaaggcgggaggatcacttgaggtcaggagttcaagaccagcctggccaacatggtgaaaccccatctctactaaaaatacaaaaaattagctgggcacggtggcacgtgcctgtaatcccagttactcgggaggctgaggcaagagaaacgcttgaacctaggaggtggaggttgcagtgagccaagattgcaccactgcactccagcctgggcaacagagccagactctgtctcaaaaaggggaaaaaaaaagaattgggtttaacattaatagtacactaatgtaaaggtgaaattcggcttatttggtacaaaactcatacaggaaacattgtcaaatatgaaacggtgtttgcttttctttgggctgtatttgtataaatgtgttattggcatatgttccaaaataataggaaattcctataattctgatatgacttagtatatgttattaataattataattgttacagaaaatcattgtatgccacagaggtaaccaaaaaaccaaagtcttatctaagatttcttctatggaacagagttccatcaaagccaatttaaaaacagcttatgtgggccaggcgtggtggctcacgcctgtaatcccagcactttgggaggccgaggcaggcagatcttaaggtcaggagatcgagaccatcctggcaaacacagtgaaaccccatctgtactaaaaatacaataaaattagccagacgtggtggcgggcgcctgtagtcccagctacttgggaggctgaggcgggagaatggcgtcaacccgggaggcaaagcttgcagtgagctgagatagcaccactgcactccagccagggcgacagagcgagactccatctcaaaaaaaaagcaaaaaaaaaaagcttatgtgaaaaatagttattcttgctgcactttatacaaataatcaggccaaagaaaaacatcctttgtcaatcatgtttttgactgtggctgtcctaagacattttgccatccacagacaattgttgtcttaatactctttaaaaggtggtttataatcaactagagaactctaacaggtattcttaaatgcaggtttctgataactttggaaattgtgatattaaaatagaggaaaaaactttcagaactctcacagagaactggaatgtccgtgaatatcaaacacagcaggagataactgcagcagctcaagtcagtaattctgaagtcatctttttgactttgcttaaaatattattgatcctttgttttgcttttcagagtcaagaaaacttttcttttgagctatttgcatttttttcttttttttttgagacggagtcttgctctgtcgccccagctggagtgcagtggcgtgatctcggctcactgcaaactccacctcccggggttcacaccattctcctgcctcagcctcccgagtagctgggactacaggcacccaccaccatgcctggctaattttttgtatttttagtagagacggggtttcactgtgttagccaggatggtctcgatctcctgacctcgtgatctgcccacctcggcctcccaaagtgctgggattacaggtgtgagccaccgcgtctggcctgcattttttaacaattgagtaaaatatactcctatgaacaaactttggagcatatttgtttctctgtacctgctttctccagaatttgcaaactagagagtattcttaacttatggcaatatagttatttgcctaattgcaacaataatttttcttttgtaaccggacacaagtggaaaagctggttattttaccaaggctttaaccggaatggtgtgtttttcctttaaggaattaaacttgacttacagagccaataaaagccccttgggaaaacaggcctcataccttgcccacacagtccctgtacagggtttctgacccatgggaagtaaagaatgtcactttccaacaggcccaggagccccaagttatctgggatcccaagatgggaggaatgtactcatcccacaggtatttgaggatacaaacccatggcagggctcggctctgaaaaagtcttatctaagattccttctgtggaacagagttccatcaaagccaatttaaaaacaccttttgtgaaaaataattattcttgctgcattttatacaaataatcagaccaaatacaataaagtaaatcggccttaccatgatttgtatttagtaaaaatgagaaactggagagagaaaaattatatttcaagaactataatacacctgttattagattctagtctcatgagttgtttttaagtttgtttctgtaatttaggctaaccctgcttattcctgtgaaccaaccagtgatctctggctgcagctcaaaaaaaaaaaaaaagggatgggtaatgtaaaaatctggatcagtattctaattctgggcatgcattggaattgctaacaaccccgtatcagcttagttccaacagttgcccagttgatgggaagccttctaatttagtttacttggaataattttacttattttgctttactcttgtggaatatattgttgttgtactctttgtgtaaaaatgaggataagtttactcaacgttttcttaaatttaacacttatgatatcaccttctgtcggaattcaagagttatgaatggccctcaccatatggatgctttctgactgagctcctctctaccctgaatgcaaaagacccagtagttgggcagtaatataattgcccctattcagcctgaagaagttgcagaagatggatctttgtccctctgcaactcttaggattaaggattctcttataaaagggaggggggaaatgtcagaggcatttgaaccagagcaattccctcttgagtaggggctgggtaaagtaagactgaaatgtactgggctacattcccaggtagttaggcatcctgagtcacaggatgaaataggaggtcagcacaagatacagctgataaagaccttgctgataaaacaggttgcagtaaaggagccggccaaatcctaccaaaaccaagatagtgatgaaagtgacctctggttttcctcactgctacactcccaccagcaccatgacagtttacaaatgccatggcgacgtcaggaagttaccctatatagtctaaaaaggagaggcatgaataatccaccccttgtttagcatatcatcaagaaataaccataaaaatgggcgacccgcaaccctcgggcggctctgtctgtggagtagccattctttattcctctactttcctaataaacttgctttcactttactctatggactcgccctgaattacttcttgcccaagatccaagaaccctctcttggggtctggattgggacccctttccagtaacagtgggagaatctcttgaacccaggaggcagaggttgcagtgagccgagatcgcaccactgcactccagcctgggcaacagagcaagactctgtcttaaaaaataaaaataaataaaattaattaaggggctgagcgtggtggctcatgtctgtaatcccagcactttgggaggccaaggcaggcggatcatttgaggtcaggagtttgagaccagcctggccaacatggtgaaaccccatctctactaaaaatataaaaatgagccaggcgtggtggtgggtgcctgtaataccagcaacctgggagtctgagacaaaagaatcgcctgaacctgggaggtggagactgcagtgagccgagatcatgccactgcactctagcctgggcgacagagcgagactccgtctcaaaaaacaaacaaacaggccaggtgcggtggctgacacctgtaattccaacactttgggaggtcgaggcgggtggatcatgaggtcaagagatcgagaccaccctggccaacgtggtgaaaccctgtctctactaaatatacaaaaattagctgtgcatggtggcgggcgcccataatcccagctacttgggaggctgaggcaggagaatcgcttgaactcaggaggcggaggttgcagtgagctgagatcacaccactgcactccagcctggtgacagagtgagactctgtctaaaaaacaaaaacaaaaacaaaaacaaccaactaaccaaacaaaatccaaataagtttgcacagaagttcaatggctccctaactgtatgctattatttttaacttttttctccttttgtctttccttttttcaaatttaattagctgatattgctgcccatgaaacagttctcagggttaggacttaacatcttgtgcctttgaaaattcgccttcaaatacaaacacgattttcccattctaaatgcaaaacagaagttccacaaaggattgctggaaagaaagcgtccacttagggccaggcgcggtggctcacgcctgtaatcccagcactttgggaggccaaggaggttggatcacctgaggtcagaagttcaagaccagcctggtcaacatggtgaagcccgtctctactaaatatacacaaattagccaggtgtggtagcgggcgcctgtaatcccagctactcgggaggctgagccaggagaatcacttgagcccggaggcagaggttgcagtgagccgagatcacgccactgcgctgcagcctgggtgatacagcgagactctttctcaaatgaaaagaaacaaacaaacaaaaaacagtctgatatccatactaattgcataattgcgtaaccttaagcaaatctcttaacatctttgattcaacgttacactgtgagggagagacactaatacctccttttatagaggaggaaattgaggtccagtgactggctcaaggtggcagagctggagagagttgaggtgcaactgtgggttcaaggtgctggcaagaggtcccccagcccccagcccctccgtgtcactcactacctgccatctcaaacagtggtataaagcccagtaaaatgtgcatgtttttatatgcatgtacaacccaaatgtaaatgtatattggtttaggtgggaaaaaataattctaaaatttgcaaaaggagttatgtcaaagtccttaaatattgatacgttaaaaagttagtaagtattctgggctgggtgaggtgtctcagcctgtaatcccagcactttggaggccaaggcgggcagatcacctgaggtcaggagtttgagaccagcctggccaacatagtgaaaccccatctctactaaaaatacaaaaattatctgggtgggtgtggtggtgcacgcctgtaatcccagctactcgggaggctgaggtgggaggatcgcttgagcccaggaggtggagattgcagtgagccgagatcacaccacagcactccagcctgggcaacagagcgagacactgcctcaaaaaaaaaaaaaaaaaagggtaataagtatcccttcatcagtgcttaataaatgtattaggaatatgagtaatttctatgcacttcaagataactaatctcaaattcatatggatatatttcagaaaagattgactctaaggaccctcatacagccatggaatgtaccgcttttttttttttttttttggagacagggtctttctgtcagagacaactgaaattttaaaataataataataataaagaactgggaattggggagatgatgatgataatgatgaggagcagaggcttgcccagcttgggtctccagggacacagcaacaagaatgagcccagaactctgcatattctatttcttgtcctcattttcagagatgtattataatctcagttttgcagatatgaaacctaaggccagccaagatatagctttaatatgcatttaaagaaaataatggctcaaaaacaaggtgcaatgctttcattctatgatcagcaatgtagatggaactgacatgtatatacaaagcattatctttaataaaattgtatcaatggttttttcttttgttttgtttgtttttgagatggagtctcgctctgtcacccaggctggaatgcactggcatgatcttggcttactacagcgtccgcctctcaggttcaagcaattctcctgcctcaggctcccaagtagctgggattacaagtgcccaccaccatgcccggctaatttttgtatttttagcggagacagggttttaccatgttggccaggccagtcttgaactcctgacctccagtgatccaccagcctcagccttccaaagtgctgggattacaggtgtgagccaccgtgcccggcctcagtgttcttcttatacttaaaaaaaattcatctcaaggggctttaagaagcaacttaatccccactgaaacaaacaagagttccttgaagaaatggccagggaatgttcaaggaaaggatgtgggcttcaaaaagaataaccataattaattgaaacccattaaataaatatttcatataaagatacatgtatatgaaaagggaggcgggagtgcttcacagacgaatgctagctaataaatggattgacagaataaggtcaacatttgctaactccagtgtaatcgctgattccgtcaaggatactcacaaagtgctaaaaccattaggtgaacagatttttggtaacaggatatttgcatgggtttttaattgaaagcgagaagcgtatctttacaatggcaagttctggcagtctccatcttaacccagtgatcaaagttagcgtcgctaatggtagcacaatctgacgtatgtgccttccaatgtgataaaatttgaaatccacatcgtctagaagtatttttgcccaaaatgtttaacctaaattgaatcaggctcctagaccagcacatgtcaatacaaatatatgtaagccacttatgtaattcaaaattttctggtaactgcatttggaaagtaaaaacaaaagagaaaagcccggggtgaaattagtttaaaaacatactttagctaacccagtatatccgaaatattacgattttaacatgtaatccatattttaaaattaatattttatattcttttttgtactgagtcatgtattttcagcatgtgtttttacactttaagtacatttcaattcagatgctaaatcttcattggaaatacttgatctgtatttagatttcataaaatttgcaattgaaaaactagctccaagttgttccacacatacatttttcctatcactgaattgagtatcagtttttcagtttaaattcaacttaacaaagatgaaatgaaatttaaattcagttcctcagctgtattcaccacattgcaagggctccagagctacatgaggcttgtggctatgatactggattaggcagccctagactgaacttccagtttagaggaaagaaagggatagtagacagacaagttaaatgacaccaagagacaatccagaatgtgggacattttacaaaacaatcgccttagacttcctaaaaaatcaatgtcataaaaaaaataagatggggagattgtcctagactaaggaaacccagagatatagcaaccataggcagcagcatgtctgaaaacaacaaaagcttagacaattgggaaaatttctttgaacacttggggaactctgaatatgtactatatgctagatggtattctggaattattgctagttttcttagttgtgataacagcattatggttatgtaggagactgctttatatctaggagggataatcattctggtggagaataattgtagaaatgcaattttaaccaggtattgaagttgaaaggagcaaaaatattgtgggcatatgagatcttaaaatatataccttctctgcaaaaagttctcttcagtaacttccaggaagttgctgaaggatactcttctccaaaatgaaggagtaagccaagaaaagaatgatgtggaatggaggagcaggtggttcagcatgagtttacaagaccctccaggacaacaagtgggaactagtcttagaaagcagccatcattgactggagcaggaagacaaaaactccaggggaggccagtcgtggtggctcacgcctataatcccagctactcgggaggctgaggcaggagaatctcttgagcccgggaggtggaggttgaagtggcctgagatcatgccattgcactccagcctggacgacacagagagactctgtctcgaaaaaaaaaaaaacaaaaaaaaaactccaggggtgatgtttccaagaaaaaaaagtactgacaggtggatcatgtgatacatttggccatattgtggagagttttataactctgtaggagaatttccagggaaaaatggataggtatgttcagtggtgtattggtaaaccacctctctgaaaaataacaacaaaaagcccaaaaaacaagaggccctgatttgtagcattgtttgatttctgtggcataaatacttccaccgtagctgatttcaaactaccaacatttgcacgcagagttggcaaaggatgtccacaatcggctctcaagggccagtaagagttggcttcaacaaaattcagcaaataaacaaaacagttattaactccaggaacaataaaaagttttataagcaatgaaatcatagtactatgcatggctcagctatgagcaatacttacaccatcacgacaatgcacacactgaatgctggtttaactttttttttaaatttattttatttatttatttatttatttttgagatggagtcttgctcttgttgcccaggctggagtgcagtggcacaatcttggctcactgcaacctctgcctcccaggctcaagcgattctcctgcctcagcctcccaagtagctgggattacaggtgcctgccaccacgaccggctaatttttgtattttcagtagagacagggtttcaccatgttggacaggtcggtctcaaactcctgacctcgtgatccgcccacctcggcctcccaaagtgctgggattacaggcactagccactgcgcccggcggttttaacttttttaaaatgtgatgtaaccacactgagaggatgagggtagagaagggtgcagaaaatggagctaaatattcattatcaatagataacacctcaaatgaaaaaaatcaagaaatagcagaatgaacattttatttagaaataagaaggtaaactggcagaagaaagggccaaaagagaccaaagttattacctgcagggtgcagaactccagcgtagagagaaatgtgcagaaagaaaagagctggctttttttttttttttttttttttgagacggagtctcgctctgtcatccaggctggagtgcagtggcgtgatcttggctcactataacctccacctcccaggttcaagtgagtctcctgcctcagcctcccgagtagctgggactacaggcatattccaccacgcctggctaatttttgtatttttagtagagacggggtttcaccatgtcagccaagctggtctcgcactcctggccttaagtaatccaccctccttggcctcccaaagtgctggagttacaggtatgagccaccatgcccggccagctggttttctttacaagccctgtagtactattagacttacacatatgcacacactcatgtgagtactcacatacacaaatactactgaggcagacttctggttatagaagactgaacacaaacttttatcactctttcctccaaaacctattgaaatgacagaaagaatataaaaggcctggcacggtgactgacgcctataatcctagcactttaggagggcgaggcatgtggatcacttgagctcagcagttcgagaccagtctgggcaacaagacaaaacccttctctaggctgggcatggtggcaggcacctgtagtcccagctactcagaaggctgaggtgggaggatcacctgagcccgggaggcaaagtttgcagtgagccgagatcccaccactgcactccagcctgggcaacagagcaagacctgtctcaaaaagaaaaaaagaaaaaatatatataaatatatatatttgttattgattatatataaacttgtatatgtatatatttattatttatataaatttatatatataaataagctggtaactgctgggaagccaggagaatgcagcagcagcaaaccaagacagttaaaattttctgagtacaagacacttggaatcacattgatttctaatcccaacatattaaaaacaaccccagacaagccaaagagagaacctcaaaaagtaagttttgccagcaaagcccccatcccaaacccctaaagtgacgtccctgtttcccttcagcccatcctgtagcctgcagataaccgcacctctaggatgcgattcctgacactgcacttcctcccacaggagggaatgaaagcggaaactccgggcggggtcccaggggactgacagccaccggagggaaggcacccctttaagagaacagttttcactgggcgcggtgactcacgcctgcgatcccagcactttgggaggccgggccctgtggattgcctgaggtcaggagttcgacaccagcttgactaacgtggtgaaaccccatctggactaaaaatacaaaaattagccaggcgtggtggcacatgcctgtaatcccagctacttgggaggctgcggcaggagaatcccttgaacctgggaggtggaggttgtggtgagccaagatcacgagccgagattgcgctgctgcactccagcccgggcaacgagagtgaagctctgccttaataaatcaatcaatcaatcaatcaatcaatcaatcagaggttctgctctgccactaagctaaatggccacctcactcccggcttctagaatcattacttttcttttttgagacagaatctcactctgtcgcccaggctggaatgcggtggcgtgatctctgctcactgcaacctccacctcccaagttcaagcgattctcctgtctcggcctcccgagcagctgcgattacaaacgcgccaccacgcccggctaatttttgtccttttagtagagacagggttttaccatgctggccaagctggtcttgaactcctgacctcaggcgatccgcccacctcggcctcccaaagggctgggattactggcgtaagccaccgcgcccggcctggaatcataacttgtatcgaccgccagacacacagggagtcagtctcacaagacaacatgataaaaacacaaagcacaatataaggcgtcagactggagaggccacggccatgattcctagcagggaatcctgaagagccactcattttgttcttgccagacgtgtcctgaatgctgtccctttccagacctggttcttcggctttctcttcaattcggtaagtttctccacatcttcccaacagagggaagaccttttcttcttgttcgtgataactagagtcagagtctgttgcttgcaatgaaaaaccattacaatacaaatatggctgaatgataagcttgaccgaatgctattatattttacatacttatatataacgataatatacaacatattacaattgataagcttggtttaatgctattatagagaatgcacattctttccaaatccccatgtaacaggaacaaaacgatatctttttttttttttttgatacggagtctcactctgttgcccaggctggagtgcagtggtgcgatcttggctcactgcaacctccacctcacgggttcaagcaagtctcctgcctcagcctcccgagtagctgggactacaggcatgcgccaccatgcccggctaatttttttgtatttttagtagagacggggtttcaccacgttggccacgctggttttgaactcctgacctcaagtgatccacctgcctcagcctcccaaagtgctaggattacaggcatgagccaccatgccaggccagaaatgatatctcttaggtaagaccacacacacaccccacatacaatcaataaacccccaaaagtagaaataaacaggccacagtataagacataataagacaaaaaatagaaatgaacaacaaaagcatatccaatcatattcacttgtgaaataaaagctgaaattatacaaaatttaggaaagattaacaggaacattacctctatgacaatctgatataatgaacaataaaatgattctcagagggaattttatagtcataacgacattcattagaaaccaaaaaagacggagaaaaagtgaatgaagtagtcaattcaaaaagctaaaaaaagacaatagaatagatcaggtaaattttttaaaatgtaaaatagaaaatgaaataaaaaatagtaaaaccaaaagttggtctttttagaagaaaaaatattcaaaattatgaatgagaaagggagtatagaattattttcaaaatcatgaaagtatgttttcattatgagtcaagaatgcctacttaggcaagacacaagatcaagcaccataaaaggaaatattgacatatttgactctgcaagaaaaaaagagttaaaacgtttgagaaataaaagaccccataaacaaaaacaacaaataagtgaacatgcagaaaatattcgttacatatataaggactaaaaactatgcttgtaaagagctactttaacacgaaaatcacatacacaaccaattttatttatttattttgagacagagtctcactttgtcgcccaggctggagtgtaatggcacagtcgacttactgcaacctccgcctcctgggttcaagcaattctcctgcctcagcctcccgagtagctgggactgcaggtgcacactaccatacctggctgatttttgtatttttagtagagacggggtttcgccatgttggccaggctggtctcaaactcctgacctcatgtgatctgcccacgttggcttcccaaagtgctgtccccaaatttttaaacacacaaaagctatacaaagttaattcttagagaaagaacggtcaataaacatttggaagaatgctcaaccacagtagcaatcaggaaaagtttaaagcaataagataccatttccgcccccatgagattcagcttagagacagggtcttgctctgtcgcccaagctggagtgcagtggcacaatcatagctcactgcatcctcaagctcctggactcaagcaatgcttcctcctgcctcagctacccccaaaactccccaaaagctgggattacaggcacatgccactgagcccagctaattttgtttttttttttggtttttttttttgttttttttttgttttttgttttttgtttttttttgacagagatgggtgttgggaggagtctcgtttgttgcccaggctggtctcgaactcctggcctgaagagatcctcttgctttggcctctcaaattgtaaggggatcgcaggcctgagccatcacgcccaccctcccccaaattaaaaaatgtgaacatatgcagtgttgaaaaggtgaggaaacaggtaactctcccatacagttggtggggaatgtagattgatagtatttttggaggacaaattagcagtatgtattacattttaaattgtgtatacccctttaaatcagttattccacttccagatatttaccctacagaaatacttgaacatgtacacagatatatatgtatgcataaagatgctgattgaagcatttttggggattagtaaaaaatggaaactttcagaaatgtcaatcagaggccgggcgcggtggctcacgcctgtaatcccagcagtttgggaggccgaggtgggcggctcacgaggtcaagagatcgagaccttcctggccaacatggtgaaacgccgtctccattaaaaatataaaaattagctgggcgtggtggcgggcgcctgtagtcccagctactcaggaggctgaggcaggagaatcgcttgaacccgggaggcggaggctgcagtgagccgagatcacgccactgcactccagcctgggcgacagagcgagacgctgtctcaaaaaaaaaaaaaaaaaaaaaaaaagaaatgtcaatcagaaagaaaagaaaggattactaagcagtcattaaaatgaatgagtaaatctgtagtacataaatcaaacaagttcccagatatatggcaaaaagtaaattactgaatgcaaatgatgtggtacagtgtcatttcagcgtgtatcacatacagatacatgtatacataagcgtggaggcaagtgtgacatagagcctttcattatttaccccatatattccagtgttgttttaattaagacaaaatataggtattcgtgggataatttttttttgtttttgagacgaagtttcgctcttgctgcccaggctggagtgcaatggcacgatctcggctcaccacaacctccacctcttgggttcaagcgattctcctgcctcagcctcccaagatgggattacaggtgtgtgccaccatgcccagctaatttttgtatttttagtagagacagggttttgccatgctggccaggctggtcttgaactcctgacctcagctgatccacccacctcggcctcccaaagtgctaggattaccggcatgagccaccgtgcccggcctcgtgtaataatatttaattaagaaaaagccgggtgccatagctcatgtctgtaatcccagcactttgggagggtgagacaggaggatcactttagtccaggagtttgagaccagcctgggcaacaaagtgacacaccatcccccacctcccgtctctacaaataattgtttttaagaaggataaagaagagtttgaaaagagagacatcaaactgttagttatatttaccttaaaaaggagagaaagaactgagatttttactttcctttctataactgttaaacaattaaaaatggaaatattatatgcaattttgtgaaaataaaaattttaaaataggccaggcgcagtggctcacgcctgtaatcccagcactctggaaaccagaggcaggcgtatcacctgaggtcaggagtttgaggccagcctggccaacatagtgaaaccctttctctactaaaaatacaaaaattagccgggtgtggtggcaggcgcctgtaatcccagctgctactcaggaagctgaggcaggagaatcacttgaacccgggaggcagaggttgcagtgagctgagattgcgccactgcactccagcctgagcgacaaagtgagactctgtctcaaaaaaaataaaaaataaaaaataaatcatccttatgaaaatacttttcaaagacaaatgaaatagaccccaacaatgtctactctagcaaattttcaaagtcataataaaaataaaataggatgactcggtggtgttttagctggtacttttccagttttccttttacaacataatcaacaatgacttcaaaaggatttccccctccttcatggaatattactaccttcaacacggcctttcagatccggagttcaaagcatagttagcattataatttcagcagagaatccagaattggcaggatatcaccagtagggtgactttttttcttttccctagcaaacagtagagcagtatgtagtttctccccccgcccagacggagtttcgctctttctcccaggctggagtacagtggcacgatctcggctccctgcaacctccgccttccgttttcaagctattctccttcctcaggctgccgagtagctgggattacaggcgccccccaccacgccaggctaatttttgtatttttagtagaggcgaggtttcaccaagttgaccaggctggtcccgaactcctgacctcgtgatccgcccgcctcagcccccaaagtgttgggattacaggcgtgagcctccgcgcccggcacagtatgtagtttctaactacaatttcaaaaacaaaaacaaaaaaaccccccccgcccccgcaaaaaaaaacctcaaaaaaaaaaatgtgacacataaatacacaaccttaactgtgtattttactgggattgtagaaaggtatcaaatgggcatgcaagtaaggtccttacggagtaagaaaacgcccaatgaacagtacttaatatgaattcgacatcgttaacactgagcgcttgctgtgtgccagcgcgcagcataattcgaagcagcatgactttgcacaatgacatattctacaagtccagtttcctaaggagtgcccttaggttacatataacctaaacgtgaaatgtagaagtacataaaggaggcataaagttaaaggggaaaaattataaatactagaaaaaattgcattgtattattttgatggctgaaaaatgggctcgaccctgcatgcacgcgttctccattgagctcgacaatatgcagtattttgtttcacgttatgtcgcagtcttagggaggagtgaaacgtggaacacgacttcacatcaaaaatgcacgttgcagaggcatttttccttcggggacgccggaagacttcgccacacgcgcgccctctccgcggacaccaacgtgctgacgcatgttcattagcgagctgctccctccattttgtccccagtctcctttaggcgaactgcgcggttctatgttaaagccacttagtaatgaaactataaaagggaggaagtggggtgggcgtgggagccccgtttgcgcaaggcaggcgcgggggactaaatggctgctggtgcagagtggggctgccccggcaccaagggctcgtcccgtggccggaaggacaaaggacacttaggggacgagggccgccgagccagcgcggagcgccttccgggtcggtgggctggggcgggctgggggctggggccgggccgacccccgcggtggggcccaccccgcaggacaaagcagcggccccgcccctcggcgcgcgcccgaggctcgtgcgtgtgagcacgcgcgccggagacggttagaaatggcggttggggcggagcagggggctggcgcgggaagcggggctgtctggctcggttacgcccccacctcgccaggaatctaggagtcggtttgttttccgaacccatctccttccgctctcccgcccctgcaggctgtgtgccgagcttggaagaaagtgtgacccgttcgacggaacaaaggacatgacagcccggccccgtgcggccactgcggagcgttaggaacattccctaaaatggcggccggcgcgtcggaacagggcgggaggcggcggcgcgtgggggcgggacggggaggggcgcggccagccgggcttctgcttccgcgaccccggcggtgcagggcgggtggagtcgcggagtagtcctcatggccgccccgccggagcccggtgagcccgaggagaggaaggtaacctgggggtcggcggggcgcgcgccgcgggtgggcggtgggtaaggacgttctccgcggagctcctaggcccggagcacgtgtcactggcttctctgccacccatgggcttgaaactattttaactgttcctagtccttatcccaagcctccaacattttaatctaagtggccgggacaaaattgaccaaaactagggggaggaggggaccagtagtactaatgacttactacaggtcattatgaaataagctaacaatactgaatctttggcgagaaaattttgctgctaagggcactgcactgtaatttgttagtaaaggctaatagtagagattaaagctccgttgaggacaggtgccttgtctttaacacgttgtattcatcacatttaacataggagtaattgctgagggatgacttgattgtactacgatgagatgaagggttaagatttcttccccatcaccagtagcctccctagctggtgtccctgtctccatactctcctgaatccaccttccactattgtccgctggccctttccagcctgtaaactggacagttttcattcctctgcctaacatccagtcgtagcagcccatcctatctctttaaggataaaacccaaattcttggtatagtaaagctaaaccaagcgctctccctggaagggctcctgtgtttcaccaaagctgacttacgtactttccccatcttcccaggcatcttgtacgtcgttacatttatcatattggaaggtaataaatgatcttgttttcctcttttcctgggctccttattaagagcagggaacctaatttatatcctcagggcagaacaggtattcagaaaagaataatgcaagaggaaaaaagtttaatataaactagggagatcgtaacattggctaatcacgagcaaatatttatagaagacccactgtgtgctaaatggctcctaatatatacttaagatattctcccagcttggaaattctgctcacttcttgctcttgcttgcttctctggtgggcttccatccaaatttggccatgacatcagatcatatggttaatattaacaaatattgtataaattgttttcatacttaatatccaacaggttgtcagtttacgtactactggtgccttatctgtttttactgtcccatacactgcccatctggaataagcttagtgtttaaaaaaaaaaaaagatctttgcatacacacagtaaatcctagattcagttttgtgataaacactggaatcctgaatgggacttttggtaggagataactgctgtttttaaaggtcataaaggtggtttaatccattggaaattaaaaaaaaaaaacttaaaagaggatcaacattgacctatttaactggcccatcagtaagtagcaaaacaatactgtagttgttgaaatgaagatagttataagcctcaaaccgagcacagtcagaggtgggaggccaaaaaaacaaaaattgctcatgaaacagtagtacctatcagagcccatcaaaaagctaattaaattaatagaagctatgatgaattaacagcccaaggtgctgtcagaaaggaagcctgcggttattttttttaaaagaatttgtcagtgatcattccagcacaacccagggaggattattttattataagaattagcaaacctaaagtaaaaatgggagttaccaagctggcataccttgatagaactagcccctaaaaactgtcctctgccacattcttgtcctttaagaaactttaaaatgtgaaatttggtacatacaggtaaattcacattcaggtaaattcttaattcacccattcaaaaaatatttagagtacctactgagtattagacactgaacgaggtactagactgatcaagacaggaaaaatccctttaaggagctgacattctactggaggaatcaataagcaagacttctactgagccagtcatgcaaagatccaggagaaaggcagcatgtgttcgttcggtaataaccatctcggcttgttagaatggcaaggccactgtacctggactagtggacaagagtaggatatgaaagagcatgggatcatgtagggcctttggagcaatggtaaggattctgagcataatcggaggctacagaggacttattatagtcatctgatacacatttttatgagtagaatcaagatctgaaaggtactgttgatagatggtaatttgataggacaggttgagcttcccaattcaaaaaaaaaattgtcttttgatgtatcagtttcagatttgggatgctcaacctgtattagcaatgaagttggtgggcagtggtctggctcaggatgtatttagaatgtggatccttccagacttgctaatatatttgatgtggatttgatgaaggaatcaaggatgactcttagtttttgggtctgaaaattggttgagtagtgtgccattaagaggaaggtttggaggtgaaaatatattttgcaaatacgaggttcaaggtgctttttatacataaaagtgtcattcattaagcagatgaatgaggctgaagcttgggagagattagggtttgatttagaaatctggagtcatcatataatggcatttaattgaaagccttgggatacctaggaagagactagattccaaaggagttaagagtggcacttcagaatcaggtctgtagaggagggaacagcaacaaaaatgtcaatgaaatagaaaaccaggagacgtatttgaagccaagtaaaagtaaaaaagtttcaaaaacaaatgataatttgtgccacatatgctgagatgcggatttagactgcagtggatgtcttttagaggtcttgactggtgtcaagtgaagttcagtggatagatgcctcactcaagtgagttaaagggagaatgggaggttttaagtagaaaagcacacctacactcagaagttttgccccaaaaggatggtggtttaggtggctgatgagaggagaggggtgtatagaggatttttgggttttttttttgagatggagtcttcttgctctgttgcccaggctggagtgcagtggtgccatcttggctcactgcaacctccgcctcctgggctcaagcgattctgcctcagcctcccgagtagctgggattacaggcatgtgctaccattcctggctaatttttgtacttttagtagagacagggttttgccatgttggccaggctggtctcgaacttccgacctcaagtgatccacccactttggcctcccaaagtgctgggatgacgggtgagccactgcacctggccaagagggctgatagtaaattattgcaagtgaaaaaactaacgatgcaaatgaaaggggtagctatagaagccaagcccttgagtatgcaagaggggaatcaagtgcccaagtgggaagactagcattagataggaatagggccaattcatcctttgcaaccagaggaaagaaatacgggcactgaagcagatttagtggtggaaaatcaactgtctctaatttgatcagatctatttctatacattattgacattctggcttggaaatctcttgagctttccttagattgatcagggtgagctggtaaagctgcttttctaaatctaagcttaaaaaatgtctgacatttccttaatttatttttaagggttcccgtttgttagtggcaaagagttaaatcttaagtatgcaggctacttaaggaatagaagagaaatgttaaaggcatgtatattatgaacagaatatttccgtatataaatagaatacttcaaagggagttatgcccgggatcctttattcatctccacttctgagcattttacagttcagtgtacttaactgtaaaggtatacaggctcaagtcgttgcatattcttcctgttttgatagaaattgcagggatttatgtactgaatcttattactccttagatatgtgacaactggaaagctccccaccaaaccctccagccttggttacttcttaatgatgtggtttggcacaatgaaaatgtcataggctttgtggtgaaactgacttctgcctccactcctgccaacacttattattagcctcttaagtccccgagcctgtttcagaggtaatctcacacaaaggctagagaattaaaaaacatgtagagagcctggcactaatacctacctcccccaccagcagctcttaattatgagatcaaccactattattttagaccagagttttgttggggattgggtttgtttcagaaggcactattttaaataagatgtgtagcttctatttagatatttgcctttaaagtcagctgagctattttcctattgtttgcaaatttacttttatttaaaaaaataaaatttcctaaagcagtgtttccccaatatgacagtcatcagaaaaaaccacctagagttttctaaacatagattccagtgattgtaaatcagaatctgagagtgggactagaaaatacttaattctatcctgtggtacaagctggtctcacacttgcatctttgcacctaagactagatcaaactggtactaatcctctggccccagcatcccatccttggggaaatagtctagtttagaggtagtcctggactggagcgctaagtccagcattcctcacctgcataacactacccacatgatcatatgtcccctgggctctcaagctgataggaaaaagtcgtcttgctaaatgaaatcccccaacctcttggtaatgtgaagaactgtactgcaaagctttgaagcaatcctatgttaggcatgcgggtgggaacggggccagacagagggaaaaaatggaatagaatgatccgagagtaaataattcttgctttattatgaaccaagtcacattttgtctcttccaacagatgcttgagccaaaaaagcaaacataggcagaaatacaattgagaatatcttcatgtttcaacctttaatctgacttgccttttactatcctttccccatttcttctaatctcttttgccttacaatatattaccttctaggtatcacctcatcctatagaatcccttctagtttaatgtcctgccccaaacaatactaacccattgaagataactatgaaacctttaaatggacagtggttccttttaaaagcagccttactgaaaattttatatacacttaaatcaagtaacagttaccgtgagttttctaaacttttgtgttaacagaaatgccagttcagcagtgtgactgttacttttaaatgtctgtcttgccgccctagagtgacagacatcccagttaaacatattaggaataagaaatacataaatccaatgaagactgtagaaaaagaattttagcacttgaaggaacttcagtcatttaacccaacccattcatgttatagattgagaccatagaaataaaagtagcctataggatacaaaagttagcggcagatctgagataaaaatccagctctttggatccccgcgtttttcaccacacttagctgtcgttcccatgtattacgaacaaagaatcaaatataatcaagtgcagcctcacttcacaggcaagaaaacagactagagtttaatatattgcccatgtttatcttaaggtgaaacatttactcttacaaccacagttgatgttaacctagttaataaaatatgaaaggtaattactaggggaattttaaacggcactacataagcaaacatgactcaaattactttttccatttctgcttcccaaattattggagttactgaagcaagctatgctgctttcaattccaatgataggcatattcccaaataaactcatttaaagagctcataaaatgaattatcctatttccaagtcagttgattagcaaattaagatacagctccaagttaccctactgcttaagggttttccggtccaatttgtaaggttttcggatttaaagattcagactgcataccaaaggtggacaaagacaacgcaagctgatttaggttgtcacgtggcacatactctagtttaaaccctcaactacaagaaaagaaatggtgtattgtcatttttgccaaagcaccccaaaatgaaatactttcttactcaatctaggttcttttttttcattctagtcccttaagctcctaggatttttagatgttgaaaatactccctgcgcccggcattcaatattgtatggttcattaggatctgttgtggctggctttggacattttttgttcactagtgagtatctgtattttttatttctctatgtactaaaaaaagcatttctctacataatgaactatttttttttctaggtggagtaatgtatataacgtaattatattctaattaattgttatgcttatttttacaggtagaattagaagatcatgtgatgttggagtaggagggtttatcttggtgactttgggatgctggtatgtttgctaagtattcaagaacatccatgattatagtaggttatctaattcaaaaagcacatgctcttttcagagcagtctcccattgggagatcctcaccctcaatgaagaatcttgatttttcaggacattttcatggaaatcttaaaatgcttgaacagataaatgcatattagacatcccattaaaaagaaagctgtggtttttacacttcacttaggaaagcctcaaccatttcccttaccctaatacttatttcatccctgcttattcatatctgaaaatgctactttaagaatgtgtttacaactactgatgagtgaatataaaatatggatgaacctcaaatatttgccagacctaagagtatgatatgtatgtactatatggttccatttatacatgaatttctacagtgagctatttaaggtggtagaaatcattttatgtagacatagcattattatcccgttaaaaacgagagcaaatacttgtttcttataatagccaatgctatcagaagacttaaaaactaatggattttatcactttacaaattgttatgtagacatcctttttttcctaataaaaaaagaatgtgttgataggtattctgacaccaaaactgcccaaaaatagcactataaattagaacatatttttcagtctcagggtagtagtcatctgtatttaagttttgtgtgatttagagaaatttcataaattaatttctgtaggactttatattaacaatttattcatattcttttcttctaaggtttcattgtaggtataattatgcaaagcaaagaatccaggaaagaattgccagagaagaaattaaaaagaagatattatatgaaggtacccacctcgatcctgaaagaaaacacaacggcagcagcagcaattgaacaatcttgagcatagaagtcaatgtaaacgaagttaagatcaaccacataaaacatttcatgtgcaataagctctcaatcaagtaaataaagtttaagttgtagtcatttttttcccacacttgtgtggaatgaaaacttgccagtttattctggccctgtgtctactgccaggatagcattcttacgtgttacatatagtggacttgtcatccttaaaatgtgaacagaatttattggcagtgtggcaaagaattataaaacatagtgtttaatgtacttggagtttccttgtagtagtaagtatagagtttgatgataagtaaacgtcccttaacaaaaacctcaaccttattactatcccattaaaaaacagcaaatacttactgagttcttgtaagagctaatgtcattgtaagatttaaaactaagggcttttatcactttgcaaattattttttaaatgcattcatcatttgacagtgttctctcatttcttaaaatgcgagtcatcttccaaaagagttgtttttaactgccctaaacatttttggggaagtatgcagggtttaaatttttaagtataattagttctgaattaaaatatgcacatggaacttgtctggcagactgatgcaatagtaaaacaactgcagaattactattaatgtaaacaatccatttgaaagtcaatcagctgctcccattaaaatattatttaaaatacaatacccacagcatctaactaaatcctcaggatttattctccgggagaaattatccctttctaggaaaatgaagttatttctggttttaattcatacaatactttaagaaaatctgttaaatataacaaaacacaagctagatgcttaagaaatgcttaaagaaatattggggcgaaggtaacagcagtcaacaggattgtggccattactggtcctattattttgatgtaccatggaaggcacagaaatcgagcaaggaagaaaatattagttattttgatctacatctttttctaaagaaaagtggagcttgcctccagttcaattcacaagagcattttccctcccatgcccaccttttcttgtggctgtcgctaggaaggatgcagaggctgtgtggtttaccaaatgccttaacttagcagtgaatgacaactgtcaaacacatgttgagggaaaatttttactgattcacaaaaaggaagacagtttgcccactcttagtggcacaaatcaaagctgcatgcactacattatccaaattagtcgtaaccaaatagttaaaaaattctgctgggcacggtggctcatacctgtaatcccagcactttgggaggccgaggcagttggatcacctgaggttaggagtttgagaccagcctggccaacagggtgaaaccctgtctcgtctaaaaatacaaaaattagccgggcgtggtggtgcatgcctgtagtcccaggtactcaggaggctgaggcaggagaatcacttgaacccgaggtggggcaggcggaggttgcagtaagccaagatcgcgccattgcactctagcctaggtgacagagtgagactccatctcaaaaaaaaaaaaaaattccataggatgttcaaccatgttttcagaggccgcactgcatgaatgcgggaaaatgttgatgatcactaatcaataatctgatatttaacaaaatatggacaggccacttatgctcagttttaccttagttattccttggtatccacaggcccaagtccctttaaataaaataccctcatatttccatataatctacatacattctcccatatactttaaatcatctctagattacttataatgtctaatacaaaataaatgctatgtaaatgtaattattatactgtgtatttttgttgttgttcttcattgttattttttgtctttttacctccagtattttcaacccacagttggttgaatccaaggatgcagaactggaggacatggagggctgacgtgtaacatacataacatataaaacaggtcccttccagcgctagcacactgcaattacatcttaccctgaataagagagaaactctgttttggctggtaaaatttccaatgtcttcaccaataacaaagctcattttcacagaagtttgcataaactggaaacctggataaaaacaaagttgtaacatatttggttggattattttttaaatgtttcatgtatttacatgatcactaataatttttattcttatgctattaagattttacaagtgtattaataaattaccaaagtctgtaacacccaccctcaataaggagagactggtagaacgaaagtctctcctatcaatgtctaccctaccatccaacttcacgtccaaactatttagttttttgccaaaccttcaatgcactatgaccttttttttttctctcttgagatggagtttcactctcgtcgcccaggctggagtacaatggcgtgatctcggctcactgtaacctccacctcccaggttcaagcgattctcctgcctcagccccccaagtagctgggattgcaggtgcgtgccaccacgtctggctaatttttgtatttttagtagagagggtttcaccatgttggccaggctggtctcgaactcctgacctcaggtgatccgcctgcctcggcctcccaaagtgctgggattacaggcgtgagccaccatgcccagtgcactatgacctttataccatatccatgctgccactcccaactttttcatttcatttggaatgccttttttacctcctctctgtaactttccattcttttgctcactagcttctgggaattacaatcaccttttcatttaagttctcactattttgtgtcttataatagttggtgcttttcttggtcaccagtatttggtacaatcacatacagcctaagtttctcattggcaaaaaccttggccatttttatctttacattctcatccaagtatctggcacaagatagtcaataaatgctagacaaaaagaaacagtccaggttcctggccaggtgcggtggctcacgcctgtaatcccagcactttgggaggccaaggcaggcagatcacacggttagaagttcgagaccagcctggccaaccatggtgaaaccccgcctgtactaaaaaaaaaaaaatacaaaaattagcctggcatggtggtgtgcaactgtaatcccagctactcaggaggctgaagcaggagaattgcttgaacccgagaggtggaggttgcagtgagccaagatcacgtcactacactccagccttggcgacagagccagactcgtctcaaaaaaaaataaaaatagtccaggttccccttcccctctatccagactttcacactttacaatttcaaactttaagagtaacctaccttccatgaccacctggaacctccagtgtacagcttccttcattgttccattaattccgaaatgtcacactaggtgatatagcagtaggtaccagctaaatagctgattaaaatagaattatggttattagtagtcttaaaaacttcttgtggcttatctatcatacctacttttaaaaaatctttaagtgctttatgcactttccccttccctcacccctccctctttggttttccttgactgtttgtgcttttccatctcagtaaaaggacctcggggaatttaaaattaactagctcttctctggacttgtgattatattgtctgagtttggcaacaagaaaatgtgactatccctaggtaccatcatttgcaagcatctctttagtctacgtacctctactccatcgctggtttccctttgcttcgattatataatgcgaggaggtctatataataaattcaggattcctgtttatgcacttttcagcaaagagctagggatcaaatagggtttcaatccttctattcatagataaaaatctgtgatggggatcaagatacccctttaaaagtcatgttaagatatacactattctttgggtaagcagaagaccttaacaaggaaagtagaaaaattaaaatgattgctgtaattctgatttttagtggtcctctagaataaaataagttttggaagtaggtatcttaaaatagtccagtagtcatcaacccaggtcaatataatataccaatatcctccaccacccaaatactggtattttacacaacttattttgcacattaagttccattttaaaatgttttaaaatgttttcttaaaaaggaagctgttagaacaaaaaaattatgaagatggttttcaaagtattacatttaaagttcataatgtgagcactacagatgttttacaaatatttttcagtgctttcaaccgttgcatttgccgtacgcttccatgttctagaataaggacatttttatgttgagaaggctacactgattacattaataggcaaatactaattctgagagaggtttctattgttcactttagaaaaatgtaggtcaatgtaatgggtgatatctgttcttaattattctaagaattaaatcctgtatgttatcagtcacctattatatggcacaccctcagggggtatcaatcattctttgcatatactggtttcttaaagggtaagtttccatagaaatgtttcttcatttgacttctaccctgaagtcatgtgaaataaaacatatatgccttaccatctaaattcaaagcttatttttgaaatgaatgtttccttttctgtaattttatgatttttctcaaatgaacagaaatggtaatgaaaccacaagttgcctactctttcgaaaccattaaattgctttatttgtgagtagacccatatttcattaagcaaactctgatagctacgtctagaatcagaagagcccaagccctctcatttcaccgaaagacattctggagcgtatagtggggaaaataaatttcctctgaagtctttttcagggaaatggaaaattacatattctggactgatacaaccaaaactcacacaagctctcccattccttcagtcttgaatttacttcctagttgattttatatacttcaatatatgaactaatcacttcattatccaaaaggatgtcaagctattttccaaattttcataagctagtaaaaatatgtatttctgaatttagtagaaatgaaaaagattttgggcaaccaaggacagaaaggtctcctatgcactgttttacattagaacattgtaaggaagtacttacactctaccaagtagggtggatatcaaaacaaatgtattgccaaaagttaaaagatgaaatcagaaaaatgatctaactttgaaaagactcaggtctattttcacatacacctgtaaacctaagcaagaggactgccaattgctaagagcacacagaatacacacttcacctcagatatgcaagagaaaacacccttttttttctgttacagagactctgtccatctgattaccaattactctcttcccccatcttttaaaaagagtcctatttaaagtgattctggaagcctaacataactattaaatgtacaagcagcaattaatttggaatacctattggaatcactggaacatttagttgggccctttaactcttccacacagcacattcacatggacagactaaggaaaaggagatgaaatgtaaatcaacacatttgtttgctttacttttcaagaaaaaaaaaaaaagttatgttggaatctttttttcttgtacgtgaccatgactctcccaatctttaactacaaacaactgatacaggatacaagctgcctcaaaaaattcctttgttagttgacatttaaataagccccaataactctttaggtatctctatatatgctttaacttttatagcattaatgtcacacttataaactggtgtctgtactagccacgtctattcttggtgttttaaaatttttaaaaatgtcttggctgtcaccaatttgtggcaatgctttaagtgtttgcaacgtatattttaccagacataacttattttacttcctgtaaggttcagaatggaactgttaaaggaatagcaggaaagaatatgccccaatagtgcagcacttctctgtcagatgtaactctccagcctgtgatctctgcattatccttcattaatgtagacagactggacatgctcatgagtaactatgtcattggcacagtatggtgatcataatggtgcaaaaaaaccctgaatctttatagaagacatttctctagagactagcctacattgacatttacttcactttcaactacagtacatagcttcttatgcccaggattcagctttaaaagcaaagcccctgctcaagacctaagtatatgctgaatcctggcatgaaaaataaagtatcctaatcaataaaaattaggtagctacaaattgacatgattacaatccctgtcctaattacttgcctaaccaagtagtgattactgatgtcctggcccatcatcaacatgtttgcctaccaacactaggcttacaatcaatagattctactacataggtgttatattttctgaataattctaggttaacattatgaatatccattatgaatatccattatgaataacccatctatctatgtccaatctactatcccttaaaactattattaaagactcctggggcaactaatgaaaattacttcaatcatttatatttttagtcaattggttaggatgtgaaagcatagtcctgctcaataatgtaagcatatcatctatttcccacctaacctcttttctgagactgtgctatttctgcatgacttgagattgacataagtgtgacgccaaataaactagcacacatattaagctaaacataatgaaaactaaatattaagatgaattgtttctgttcaatttcaaaaatatacccttggggacccctggtttttcatctactccaacacactcaagagatatatactacattagtagtatagctcacttccaaattctcaagggcttattctaattaacaagtttagtaacaaaggttagtaagacaaaggtcactccaacatgagttagctggacaaagtacttttaatgcttattttacaaatatgtacctgtggtgctaatactaggcaaagaaaacaggacgattcaagagcagcctatgtaactaccaactcaagcactaacactagctagatcaccttcatgctttaaaatttaaagttatggagtagctgtgcccacacccccccccaaaaaaaagctttaataaaggcactgcagcgttaactaagttttagggtaaatttaggcaattaacaattcgaagagacttgtggtttatgtattagtaattcaaattactgttttagagatctcaggtagttaaccaattcttgctcaaagcactaatgttcagtccctcaccatttatgctgggtatgagtcccaatgcatgggtattgcaacctattgtcaggccttaacatgtatgtgtttgcttttattattactaaaatgttaaaacttaaacccaattattcaccaaactctgaacacctcaacctcagagctccagaattaggaatgaatgacaaagtttagactctaatcattttaagaatgttaggtgggaagaaatggcttcagatgcagtattgtgttcatctttccaggggaacatctcaaatgggtattctgaagcaggttgagaagtagataaaattctctgctacaagttccatccactttttttttttcaagagaccaggtctcactatgttgcccaggatggtctcaaactcctgagctcaagtgatcctcccgccttggcctcccaaagtgctaggattacaggcgtgagccaccacacccagccaagttccatccacttttgaaaacaagacatttatgtataggaagagaattatggaaacactttgtaaaacatccatttattatatccaatgctaaacactaccacttggactctaagatatgtttatgcctctctgtttattctagttttttaaaaatcaaatatacaagatctacaattatttatatccaagatgtctacaccactgcctaagaagctattaaaatatttgtatttgtgcaatggaacccattattcacatggtcctagaataaaaagtcaatttatattgtgaataaatttatcaaaaaacatgtcatccaattcccacaaatgagacattttaaatacagaatacactctgttcatgaatataaaatccccaggtgaaagtcccttaaaacactattatggttatgtttcctagaataattttataactttttcagagaattcctttaaacttgttaaaataccttgttgctagtgctcagaacatctaggttcagtctttatttttaagacagtatctatcctaggcaaatgagagcttgtttttatgtatttaagagtttcctcttgtcatttcaatgtcaaattgatttgactcaatttcatgatttcatctcgctcaaggccatcaaccggtcagagccagagcccttcaaaggctgtatgtgagtatatgagggaaaactttccacataattttacatcatttctatctcatagcagttttagttttctcatagctatctcatagcagttttagttttctcaaattctatgctgtttttgtactactgcagctgaccaatccaaagccagtttacactcagcatgtgttattctactttaaaatataaccttagtgaaagcacccttcaaatcaacagcaatctcacagtgagtttcctctgggtagtcaggatttgtccagaactacatccttttcagatgttcagagttttgcttgccattagggaggcaagggaaggatgagcaataaatcaggtttctcgttcgtatcttacttcttacctaattttctccctgttgcttatttggtacattcccttctctgaattccttaaacactttataaggttatttctgccatacaagtgtagacaattgtattaattctagtcttgactaaagattttaacatttttctgggtgccatttttatctattctctctccccccaaattctctgggctaaacaggcatgatagtctacctagtgttacttgaccattactttcccactgcaattataaaatgaattccttaataagcaattttaaactagaagatatatccaaaactttttaaaggcacaaaggacaactttaggacacaacactgattagcatcaaaacctgaaactgttcctctagtaagtctatgcaatcctaataatgtatactgaagagtagtagctcaggccagtggttcttagcattacttgctaaaaaagataaaaatccatgacactatcttcaactgttaaatatcttatgttaactaaggatttgcctgttccaaaaatgtctcaactgaacctatacatcacctaaactccagcttatagcaagaaaattccttagaagtatgaattcatatttatgatctgattttaaagggctaaaacaaaattctaagcaatcagaaatatagcaaacctaaacttaccaaagcaacctaaaaacaccaaggaaacgctagactgaagtcaaattttagttctacagtttgactcctgattcctcacttcacattggtgaggggaagattaaagtgttctgtgcaaacccaatataattacaattaggggatctaatgttattacatagctacagtcaagttagcagtgttgtgtagcagtgacatcaatgactggcttgcatgatggcttctaaaagcatctgatcccagagtttcatgtatcatatatatgtatataaaataatcagttgaggacagcattagcattctgtaaagatgataaactcagtgttaacttctcccagccagtaccttttcccctcattaaatatgttaaaagttgtctgggggggaggggaagggaagaattcaactttacttcataattatgtatcaattgtcagtatacatttaagtttttaaaacctaaatgttctatgcagagtaaagaataagctgtccagaaagcacacacttaataaatttctcctcttgggagttatataaagggattttgaaccttgatggcgagaatcccaaaacaagagtaaaatgaattctttttattgcaaacaaacgtctaaattaatttctccacccactttctttagaaagaaaaagaaatcagcaggctaaggagatacccattcaagaactgacatgattaaaaattaagatataaatgggtgactcacaatttcattagcttacaaagatggtggagttaactactacaagcacactagttatacagtattttgtgggagaagggcatacagacatggctaacttcatatagatcccattagacaactggatttacaacaagtttttttaataagaaatgggcaaagccagctttcttttcagaatcaaaatgcagaacaaatggaaaaattatggtattaaccttcacaagtttgagcctccacaaataatgcaaccaagttttacatttttaacagcccttctacatacactccatcttctctatcttagttccaagttttagttttcaatcccaattataccaattccattgttattttaagaaaaaaccttcccagttattgtcagaaactatgatttagcttaccccctccactacccagcaaactacagagaggatggagtgtaatatgagcagtacagagtcttaatgcaattcatgaggaccacttagtccttacatgaatctggttgctaacatttctattatattgtgacaatgactcccgactgttattctctgtgagaaatggggggagtaaattcttaataaaagacaccaggtacaaagcaacattttacttctgttgtgataaaaaaaaaaaaaagtcacattttacagataaaatgtagaaccctgaaatactgacacattctcttatcgtgcacaatgctgaggttctcttacgattcacttttaaactgcaattaaaaatgtacaaaaaagaaaagaaaaaaaatcaacccacaaagcttctaaaaaaggaacccgcaggcacttcctcttgtggaatgtttaaaaagttagcctactaaagaaaacagtcgacttcttgtgaaggttttggagaaatatgtatcagttcgttttatttgggtattcaataatatccttggtgataatgctgactccatggcttctgaccccagaattgctgtaagagaaaattttgtttttaaagaaaaaacatcaataagccactcaaactgtttttaggaaatgacaatgaatctaattcagagtaatttgctggaaacaaatttatacctgtcatacctctgatttctaccaaaccagatttagttttaatatcccataattatcaatacacattacaaaacgaaacatcatgactttgttagtttacacaattaaagctagcagtaaaagaactgtatatattaaataatattactttattaaaaaaatttaacttatagcaatcttcaacctattttgccttcaaaaggtagattatggctactactgcaagacgattcacactttaccctattaacacttataaacacttcaatccctgaacaagatctttttcaagactgataaatcttaggaactcaaaatacaattaatgtacataaagcacataagaaattacttacaccctgctgccactggttgtagccctgagattgatttttgtagccacgattgtttcctcgtcctctgaagttctacaaaaaggaaatactctctaagagctctgagcccaattgcttgttaggtttgtgggggtgagagagaggagcagaaatggacaggttgctagcccctaatcttaggtagcaagcaatacacaaattctggataccctctgctggtttcttatgttttaattttttattcattatgagaaatgcatctgacttgtttagtacacctgaaaaaactcaaaagtaagtagactcatttcaccattactagttcaattttccttatgtcaatgcctatcatgttccttacggattactaagacaccccaacataaagctcacacctttccagactaagctacagttatcaatcatgcttccagggatcttgaatcattacctggttgtagttccctctgttgggcattccacctctgttgtagttccctctgtttgagtaactaccacggccaggaaaaacaggggcacgagggtatggatagccgattccaccacttcctccaccgccaccacctctctgtggcatgttgcccctcctattatatccgccacgattcccaggggctaaaagacaagagctgttttagtttcattgtatattgtaccctacttatacagaagacttaggattcctctagattgttcctttttctccaaaaataattgtttaaagacaaaagaaatgtttaattctaaccattaacataacctaggtgtatttaatatcaaatcacatgaatactttagttactgtgacagtataccattaatgaggaagaaacttcagctacatccaaactataaaattatcacttgtttcgatcctgaactaaatacagaacactcaaaattaacttgcctcctcctctgaaatttccaccacgcatattgaatcctccacgtcctctatggccaccacctctgttaaactggttcttgccactcttatttttattgcttttctttgagccagtgttctgtttcttttctggtggaagagcctttttgctttcttccttatattgctccaagagtttttgggcttcttccttctgaagttcaacataggttatttcatcaaagcactcagctacctctgggagggtaaagtttcctgcaggaaacaaagtcatattattaatttagaaacccaccacgaatcctcacaatcctaaagctgacaattcttgaggtttagtaacatattttcctaaaaataaaaacagaccaaacatatatgcatatgtaacaactgcaattttaattcctgaagcagtattgctggaaaaaatgttaactttcaggaggcctaagtcctaatagatttaacatagttacacaagcagaatatgtaggaaaaacattcttttaaaaagaagatttcacacagtaacagaattaaaattccatgcctttcattttgaggaccgcatgttctggtaggtctttcccctctacttctgctttcttctgtgttctttgcttatagtcttcatcttttgggcaaactacaacagcttttcgctggaagcctgcaaacaggcacatttttctcctctgggcagcagcagacacatttgtctttaaaaaaagaaatttatgtttacaaccctaaacattaattctacaccaatctatctaaattatcagttaatatttttcaatttcaaagctacagcgtacctgatccagaataaaatttcgcttctttcgggcagcaatctcaataaatttcccaagacactggggggctctctgcaacagtgtgttcagttttccagtatctgccatttgcttcttaaaacctgccacctatattcaaaagttaaaatttccccttgaacttgtgaattttaataagttatgctttttaaaattcaactcatatctatatgtaaagcaggcaacattttataatttaaatattacctttgtccattattgctacaaaaacagggtcacttaaactatgtaacaagaccttacacttactcaattctttttagctgctagatgttaagagctcaaaaacactacggaaaaaaacagaagcctagccagtggaaggcagtttaccctcagagttgaaagaaccaacttaatcttgcctttcctcccatctctttaagatactaacaaaatggatagagacaaagacaaaaagtttacctagaatacctcccggtctataatttttcttttcttttttttttttttctgagacggagtgttgctctgtcgcccagactggagtacaatggcacgatctcaactcactgcaacctctgcctcccaggttcaagtaattgtccctgcctcaacctcccgagcagctgggattacaggaacccactaccacacccagctaatttttaaatttttagtaggaacggggcttcgccatgttggccaggtgggtctcaaactcctgacctcaggtgatccatccacctcagcctctcaaaatgctgagattacaggcgtgaaccaccatgcccagcctctcccagtctattttaaacactgagatcaggccctaaacattttacttaccatcatcttatccataatagtatttgtgccaagaatgttatatttccctggattttctgctgcatgtttagtaacccaggtagtttttccagctcctggcaagccaatcatcatcacaacctagtgaaaagaaaagaaatgtcatttcactgtcagtagacaccacctaataattctttaaatattgttaaggccaatttaaatatctaagttttcatagcccttacactaacggacaaaaatttgtttatggaaagattaacagtcaacataagggggaaacaattacttaagagcaatatgcacagcacaaagtaaatgaaacagactaatcatctagttcttctaaatgtcattttgtgccaggcaagcaatattcaaatgccacagttaaaaaaaaaaaaatcccttacttcacaatctttcttctcttcaggcccctttggtcctctaactcgatcctctaaggggacgttctggatgaaagtatactcttcaggtattggaaaatatggcttttccttctgaccaaaattaaattcaactgcacagttgtggcagagaacatgcgggaacagtggccgtccagcaagaacttccttactgattttgaaggcaacgccaagatcttgtccattcttagcatacgagagttctacttcatcactttcaaagttctgttacacagaaaaaaattcaacagttaaaatctgcttccttaaactttctaaaaaactaagaattaaaattaggagcaaagcttatcctgtggaagctacaggttaaagaactattaggtggcctttaagggctacacagttaagaaatctgatggttgtaaaccatgaagcacgtatctccagaaccagaaacaatactgacctagaagctagactgaattttctaggtcaatttcatgttcactgttttcagtcaaaatgaattagtgagttcctcaaaaatgtcctgtgttttcccaattcaactgctgaatgaagtctttacactaatccagggactggtgtattttgttgctcatattgaaaactgacctcagtaaagcttctttaaagttcctagatatagctactaactttgccatttatacatagaaagttagctttaacttacagcaaaacatgtaatcacatcattttcatcaaacttttctccataatcttcagtctcacagttgcatgtttttattccttttagagaatacccataagaaaattcttcttcacctaagaaaataattaatcttcatgaagtagatgtttaaaatagtccaaagactcatctattttactacttaagatgtaggctacaagagaaataagcatataacctaatcacctgtcactgacactattacttttctatctctgtaccagaattgatggaagttaggagggatatatacgcagagaccaaattagttgacgatttgcatatcacgggtaagattttatttcaaccattggtcataaacttctaataaaggaacaaaaactaaaatgtagcctgtgcctactatgtgctaatattacctgtctgaagtattaacagaatagataaaaacagacaaaaggcttagaatgccctctagttaaaaaacactgaaatcagaccctcctgaacattcatgagcccacatcagtcaaaaagaagctttaccaagtaacattccacttgtagttagtgaccagccaatacgaacttcatgtatgtcaatatcttttgtatataaatgccttactgggatcttctctgtaacctgaaagtcaaatcattaaataattaaaataatacaccaaggaggtaaccccttaactctcgcatatttcattgcgccacgggctaatcttcctctagctataaatacaaagaaggcacactctagcccacccccaatatttgtaagaactttaaactgatgtgcttataacttgaaatttaaagagttaaatacttatttgacccatatttaaaagaatacttaatatttttaaagttcatgttgtcagtctttaacttaaagccaattaaaggatacaattaatgtttttctcaccaacaaaagcagtaatgtaaccaaattttatttttaactctttggtggccctttcaaatgcttgataaaaatgaagtaccctaaataaaaaatcgcctagctctgcatggcaagttctaacataacaaccgtgattaactgtcacaacaaaatgaaggttccaagctcctcttttaatttacaggaagcttcaaaaataagtacctttgataacttagcagtatgaagcacctgtaattccagcattctgagaggctcaggcgggcagatcacttgagcttaggagttcaagaccagcctgggcaacatggtgagaccttgtcactattttaaaaaggaaaaaaaaaggctgggcacagtggctcatgcctgtaatcccagcactttgggacgccgagacagtggatcacctgaggtcaagagttggcgaccagcctggcctacgtggtgaaaccccatctctattaaaaatacaaaaattagccaggtgtggtagtgtgtgcctctagtccgagctacttgagagactgaagcaaggagaatcgcttgaacccaggacgcggaggttgcagtgagcctaggtcgcaccacggcaatccagcctagggaacagagtgagactgtctccacaaacaaacaaacaaatcataaaattgcatttaccttcatctcaaaacacactttgccttttgacacaccataggatgctcttcctccagcccaaagaaaagcaaaactctccattgtaagggaagaagcactgagacgatctcttgatattttaaaatgtagatcacaattatctgtaattatatcaaatactgtgttacttttgacatccaatgtaaacatatctgctatgtagacaaaacttggttacttaatttttgcatgtacttcttaatgctgcacaacttttctccacatcatgctgttgttccaattttcagtttaaagccccactcccaccaagtcactcctgttaaattatgtactgaaaagtaaactgcctgtgaaactaataccaaggtttaacatgtatattttaagtatttaaaataatcaagacaatgtgacattaatacatacctgctctgctctttaccttgatttagaggcaagcagtagaggatagcaggaaatcaaagtgaagcatgccagaaccaggtagatttaccagtgccacattaaaactgaagggaggccacgaccaaattattttaaaataggagtatgagctgctgttgatcctgcaccagggctctagctcctaaattctttttctaaaacttgtgaagaagacagcctaaaactatgaagtacaaacctggccgtctaatgctgttaatagtgcagcattttaggtcctctttacccaggactgcctgttcaacaattagggattaattgcttcccggattatccaaatccaaagtgtctttaacccagctacctatgggtcactggctcattaacatgcacttcctcagacttctcacttgaacagctaaagtcaagctggaactcattttctttttactgatcagagaaaaataaatctacagtttggaatttttcttaaattagagttattctaatcaacagaatttaattcaacagattgtttgaattcaacattgtacttatattgacatattcctgatttgctaaaaaatctaacaattacattacctgtgtgagtcaccacttcactaccttgccaattcctagcaacttatttatacaacccagaatttcactaaaactttcacatcaactaactcctttttcacctgcagttttttcttttaaaaaggctcagatgactatctcaaccttctgtaaaggatattccagtaagaaagagttttacattgacactcttacaaatctgaataaagccaatttgtacaagaaaacatgagaagctaagctccaatgccttccatctaacacagcaggctgacaccatagctgatacttttgaaacagttatttttatcctttggtctatttatcacacccagagttgtacattctcatcactaaaccaactacgtttttttgtaacaaaaaaaaaaaaaaaaaaaacaagtctgacagtcaaagcccacttagaggtttgcaatactttctcactcaattgcaacccaactgggtaaagtagcagtatttacagtgctgcactgccattgataccattcgctgctgaagaaagctagtggcccagtgatagcccactgctgctgcctcaggtctttggaagaaatcaacttatgtttaaagcagcagctactgaactggaattgagaacaaaagagcagttattgaaaaagtaatattacaatcttttaaaatagggaatatacttgtgtgctaatgggagaagtcattagtaaatatttaactagcccaaatagctcacttaatataattccacaaaaaaatgaattactttattgtagaagcctgtaaggctaaattataggtagtgttacaagtttccgttagctagtcaaaaactggcattaattttacatttcctaagaatgagaactttcaagtcataaaaatacgaaactcctagagcctgtaaaataatccacttaatacaactgatgacgtgctaaatattaaactactaggttctgaatgtaaaccattatcttcctgcttttaaaaaaactaacccaagttttgctgcacttaagcattaagacttctaaaaaaaaaaaaaaaaaaaccaccatcaccgcatttcataattggggagaaacagcttcacttacaagtatcaagacaaaccactgtgtcatcgaagtgttcatcttcttcttcaacaggtggctgaggagatttggctctgaaagacagaattgtctcctgatacagctttccgatcaacgaacgaataagggatgagtaaaactaggtgagcatcctatacctgctatacttgttctcttcaatgtactcaaaatatccacggccatgatcttctcgtggtcttttaacacccctctttttatctccgcctttctgttctgttttgccgtcccctaaaacacacacgagccccataaaggccaagcctctaaacaacaaaaaaacgcttttccgttccgagaaccaaagcagctcgactttatcctgctttttaactgaggttttaaccgaggactcaaatgtgaattcaaagaacaatcaactacgaattcgattggcgctagtgacgcagtctaaagacattactaattttgccagtctcctcgatgattcgagaaagccaaagaaaaactgcgcggcccaggcccgaagcccacgtgtatcccgaagagagcgcagagagggggaggggccgagcccggcgcggcggcgctcccctcccccgcgggcccgcgctccccgcggccgcattgtactgatcttccgccccccgccccgccccgcccggctcctcccgccggaagtgacgtcacgccgagcccctgcgctccttgcacaatacagcggcgaggagccgccaaagcgcgcccgccccgggacctggggcctctcccctccccccgagacatgtgcccgcaccgcgcgcacgcagcgcgacggcgccaccgcgggccgaccgggctccctcccgccgcccgcccgcggctcctccccctacagcggcagctgcagctccccccggctctcgagccacataatggaggcgctgccaccgccgacacacacacacacacacacacacacgcgcgcgcgcacacacacgccccgagcccgaggcctctcggctaatctgggattccccgcgccccctcccccaccctcaccgcggcgccctcccgcccggggctccctccccctgcggggctccggcaggcctggggcacggtccccaccccgcgcgggcctcccgccgcgcgcaacgtacaacgcagcactcacccgccgccggagccccggggcgaccgccgcctccgccgccttccgccttcttcttacctcccgcctgctgctggccctgcctcgccccgggcggcgccaccgtcaccgcgaacagcgaggtggggccgctgctcttccccgcggcctccttggcggccccgcgctgctgttggggctgttgctgctgcgtcgccggcggttgaggctgctgctccccgtgcccgttctcgtcgcccgcgccttcctcttcgtccccgagctcatcttccccttcctggaaaccctgatcgtcgccgttctcgtcttccgaggcggcctcctcctcctccatcgggcccgagtcggccgcccccgcggccccgttctcctctcctagctccatctggtcgccgtccagagcggagattccttcctcctcctcttcctcttcctcctcctcttcatcgccgccggccgcggcctcctgctcgaggcctgctcccgagcgcccagcggaatccccgcccaggtctaggctgccgttcccgggctccatggcggggcggcccccggcctcctcgtcgtccagcgcagcctggagtcgctccatgagctcggccttgagacccttgtcagaaaggcgtcgcttcttgagctcctctttcagctccgacaccttcagcttttttacattaacaggcgaggaactcatggtgagggccccgattcaccgctaggcgctgcctcaaactcggctccgctcactcggccactggtggcggctgctgcggctgctcctcggcccgggcggcggctgcggctgcggctggagatgggttcgtgctgcagagcggatccgcctggtgtcgaacggcgccaattcctttcaccgagttcgcgagggagacgcggagactcgcctggcgcgagcgagcacgcaacgtcctctcgcaggagcggcgccgcgcacgtaatataggcgccccgccccctgcgctgacgggagcactgcgcaggaggaaagccggagcgcgcccgcgctcggccccgcccattaccgtacttacctccccgcccccacgccgaacccgggccgagagcgcggtggaggccgcgcagtgcgcttccaattgggactgagcaaatggaggaaaaggaaaccgcctttcagttcaaccgactcactgcatgatatattggcctttctgggtctttggtggctatactcgtttggcttttctccttcccagcttggaggctgctttatccaaatgctttcttcagtcctcaacttggcgtttcaacccgaatccgccttttcttccatcttagatctgccttcttatgtgtttctccagctcttcgtttaaaactccttcaaatcgtatttcagttttgactggtatagcatacattggcaactgttacacgcagcggctcttttcctcataataccgtatttggtttaatttgtgtaagtcctgccttgcgaattggattttaagttcgagaagggcaagggcagaaccgttcttttgtctgttccacaccccgggtgcggggcctgggaagtagaggctttgcttactactccatactgcaaaccttagtgtacctgcctttgcagggcagctattctcatgctcttaataaccctgaataaacctcagaattgcatttccaagttttctgtagctaccacaaagacggacctccagtaacacttgttctgtccactttaggacctggtcatcagctacgaagtcccagtagctaaccgtgagggtgagacccaactaggtctttgattataggcccacttgattctcttcctattcctgtagaaatactcttgaccaaattattctgaaacttaaagtttacgaaaaatcaagggctgtgattttgtaaaaagaaaaatggactatcgctcttgaaatccgttattttatatgttagaagtttactttttctctttaaagaaaagatgtgatgtctcgaagttttagatagggaagtcagaatttagattcgtgatagaagttaacattttaaaccctagataatctgcagtgtccagccagtgttccatctgactaaggagatggtttatacccactgtttggtgctctaggtggcacaataatattgccccattattaatttgaaatttggaagtaaacacattgaaatttctcccataggctaatatgatttaactaattgatacattttatttttgaagtttattttcggtagcttttatgaagcattctaccataccttgcagtcatgtatacgtgaaatattaacacttgtgaaatgatttgacttgaaattaatggactatgtacagtactactgataatccccagttcaagttaagtggtgaggatagcccccaaaatagaaacttccaaacagtgccagaaactcattttagcctttggttataattttgaaggttatgaataagccacaaactggaatttgaaattttgtcttcgttcagaaatgggaagagagctacagggggtttacatgttcacaaactagataactaatcccttaatgaatcagagttaaatacaattatgatggttccttaaatttatgtgtcctagatattatttacacctttaaatattagttatatgaaaacaaatttcatttactggaaaacactaaactatgaaaacaaagattgtatatctacatatagtagatctgtaacagtcactcttggaacattaagtcagttgcaaaaataaacatgaaatacaacttttgatgctcacaagaaagttctatggctttatctccaaaagttttggagaactttagagctggatggggcctggagatcgatctgcagtcctgttcattttactgcccaggaagctgggaccctcaccccccacaccaatgggctttctattacattgtgctgtcttagacaacatttgaaagaaaaacaatttctgctcaaagaaccatcatcatactatccttttcacaaacagaggaaatatgccattccatagtcttatgttaccacttcaaagtacaaatggtgacatcttattgatcatttttgcttcttatatttttaatgctatcatgatagtcctgctctacagagacctgttaaagtgcaggtcacttcctgtaaatctctgaaggacctctaagacaatttaaattccccctgtgtcaaatcctagaggctaccaagaataccgcgtgccggaggagacaagttaattctcaataacaaaaaatgattcaagaatgacctatgaataattgatctgtgagaggtaactacaaagttttggtgctctgcatgtctagcttacatttttgaggtttaagcaaaggaaatgctatactttgtcacacaatttattcagcaaatattttttcaatactttctcaaaaacattttatagtcataacgatgaggcagttccagagatctacagttaacaaagtatcctgcacttaaaaatttgctggccaggcccagcggctcatgtctgtaatcccagcacttcgagaggccgagatgggaagatggcttgaggccaggagttcgaaaccagcctgaggaacacagtgagactccatctccacaaaaaattaaaattaggtggctgtggtggtacgcctgtagtccgagctactcaaggggctgaggtagcaggatcacttgacccccggcagtcaaggctgcagtgagccgtgattgtaccactgcactctaacctggaccacagagggagaccctgtctcaaaaaaaaaaaaaaagaaaaaagaaagaaaaagaaaaaaacccgttaagatcttacgttaaatattctcattcccccccgccccccaaaaaaaacaaaacaaaacaaaaaacaagatcgggagtggtggctcacacctgtaatcccagcactttgggaggctgaggtgggcagatcacctgaggtcaggagttcgagaccagcctggccaacatgttgaaaccccatctctactaaaaacacaaaaaatagccaggcgtggtggtggccgcctgtaatcccagctactcaggagcctgaggcaggagaatcacttgaacctgggaggcggaggttgcagtgagctgagactgagccactgaactccagcctgggggacaaagcaaaacttcgtctcaaaaaaaaaaaaaaaaaaaaaaggccgggcgcggtggctcacgcctataatcccagcactgtgggaggccgaggcgggcggatcatgaggtcaggagatcaagaccatcttggttaacacagtgaaaccccatctctactaaaaatacaaaaaattagctgggcgtggcagcgtgcgcctgtaataccagctactcgggaggctgaggcaggagaatggcgtgaaccctggaggcggagcttgcagtgagccgagatcgcaccactgcactccagcccgggcaacagagcgagactccgtctaaaaaaaaaaaaaaaaagaaagaaagaaagaaaaagaaaaagagccgggagcagtgtgggctcaagcctgtaatcccagcaccttgggaggccaaggcgggcggatcacctgaggtcgggagtttgagaccagcctgaccaacatggtctctactaaaaatacaagattagccgggttcggtggcaggcgcctgtaatcccagctactagaggggctcaggcaggagaatcgcttgagccttggaggcagaggttgcggtgagccgagattgcgccattgcactccagcctgggcaacaagagcaaaactccacctcaaaaaaaaaaaaaaagggaaaatgaaaaagaaaaaaaaggacaaaggtacacaaggaaactgttggaggtaatggatatgttcattttcctgaatgtggtgatggtagcatgcgtgtgtatgtctgtccaaactcaccaaatatgtatagatttattagttatatgcagggttttctttttttttgagacaaagtttcactttgttgcccaggctggagtgcagtggaaccgtctcagctcactacaacccccgcctcccgggttcaagcaattcttgtgcctcagcctccctcgtagctgggatcacaggcgttcaccaccaccctcggctgattttttttttttttttttttttgtatttttgtagagacagggtttcaccatgttgcccaggctggtcgtgaactactgagctcaggcaatccacccatctcggcctcccagagtgctaggattacaggcgtgagccaccgtgcccggcctatatgcagttatcgtataccaattatacctccataaagctggggaggttgggggaggaagacaaaagaattcaggcctgcggggaatgatgggagtgggtaggagaggagagaggggagagaggaaaacacagatcaccagcagcctcgtgggtggttttgtaaaggactttggcttttgctttctgctatggactgaacgtttgtgtccccacaaaagtcctgtgttgaaacctaatcccccatgatattaggagctgaggcctttggaggcaacgaggtcatgagcgtggagccctcatcaatgggattagaaaatttatacagagctgaagagaccagcgttcgtgtcttctgccctgtgaggacacagcaagaaggtgccctgggtggggaggcgggccctcaccagtcactgaggcgctgggcttcttagcttccagaactgcgaccaataagtgtctgttgtttataagctactcggcttatgatgtttgttagaagagcccaaatggactaaaacacctccaggaggagggaagacatagaacgttgttagcagagtgacatgaggggacaagaatgctaaattaaaaggactcgagaggctgttctatttaacttggtttttgtttgtttgttttgatctggagtgcagtggcgcaatttcggttcactgcaacctctgccttccgggttcaagcaattctcctgcctcagcctctctagtaggtggggttacaggcgttggccaccacgcccagctaattatttgtatttttagtggagacggggtttcaccatgttggtcagactggtattgaactcccgacctcaagggatccacccgccttggcctctcaaagtgctgggattacaggtgtgcgccacctccagctaatttttgcatttttagtagagacaggggtttgccatgttggccaggctagtcttgaactcctgacctcaactgatccacccaccttggcctcccaaagtgctgagattataagcatgagccaccatgcccggccttaacccctttttttgtttttgtgttttttgtatagcacgatcaagcccaatttaaattaatcaaagatgcataaaatatactgagatacattttccaatgtattttacaaaagatgtaagagtcagaaacacctccaaagtattctgtactaaaagtagacattttcacatagacaaacaggaaagcccagctgcaagggaggaggtaccaagttctggttagaagtgcaaactttcaactcagaaagtcgaagctgtaccacatagtcgctgcgtgattttgcacaagctatttttctctccatgcctgagtttactcatgtataaaaataatacttgccacctgaagttgttggggaaattcaacaaataactgaatacagtgcttggcacacagtaaaagctcaaaaaatagtagtcttcatcagacacactgaacaattttaggcagttaaaaatctatgattggctgggcgcggtgactcacacctgtaatcccagcacttggggaggccaaggtgagtggatcacctgaggtcaggagatctagaacagcctagcaacatggtgaaaccccgcctctactaaagatacaaaaattagccagcgccttagtcccagctactcaggaagctgagacaggggaattgcttgaacccgagaggtggaggttgcagtgagtcgagattgcacgactgcactccagcctgggcagcagagcgagactccatctaaataaattaattagttaaaaaaaaacctacgattgagtgattaatactaaatcttatcaaggaaattataactacatgtattttgtaagttatcaatgaattgtttgtggtaagatgtcaatctgggaataagtgaagcaaagtctaaacataagtatgtaggttgggtacagtgacccacacctgtgatctcactattctgagaggctagaggtgggaggatctcttgggtccaggaggtcaagaccggcctgggcaacatagcaagaccctgtctctaaaaataaataaataaataaataaaaataaaaagtattttttaattagccaggcattatggtgagtgcctgtagtcctagctactggggaggccaaggtgggaggatgacttgagcctaggagtcgaaggttacagtgagcaggctgggtgtggtggctcacgcctgtaatcccagcactttgggagatcaaggtgggtggatcacctgaggtcaggagtttgagaccagcctggccaacatggtgaaaccccctgtctactaaaaatacaaaataattagctgggttcggtagcaggcacctgtaattccagctactagggggactcaggcaggagaatcgcttgaaccctggaggcagaggttgcattgagccaagatctcgccaccgtactccagcctgggccacagagtgacactctgtcttaaaaaaaaaaggttacagtgagcaatgatcatgccactgcactccggcctgggcagcagagcaagagcctgtcttcaaaaatacatttaaaaaataaaacacaagtaccagacttgacttcgaggcccagcgctgttatgataaccaactgtgtgaccttgagcgaattgcatgacttctctggatattagttttcttgtctataaatgaagcagatcaagccaggcatggtggctcatacctgtaatcccagcacttcgggaggcttaggtgggagaatggcttgagctcaggagttcgaggtcagcttgggcaatatagcaagaccttgcctctactgaaaaaaaaaaaattagccaggtgtggtggcacatgcctgtagtcttagctacctgggagcagggaggtgggaagatcgcttgagcccaggagattgaggctgcagtgagctgttattacaccagcactccagccctggcaacagagcaagaccctgtatcaggaaaaaaaaaaaaaaaaaaaagcggagtaaactagatttgtagaggccccctcaaggggaaccttccatgagtttcgtttttgctgacctgaagaaaactataaatgggcaagcttcgttaaactttgaaataatagtttattcatatttagcttttacttgttaaaactttgctctagagtctcacagtattttataattaattagcagacatgaaattttttttttttttttgagacggagtcttgctctgtcgcccaggctggagtgcagtggcacagtctcagctcactagaagctccgcctcctgggttcacgccattctcctgcctcagcctcccgagtagctgggactacaggcgcctgctaccacgcctggttaactttttgtgtttttttttagtagagacagggttccaccatgttagccaggatggtctcgagctcctgacctcatgatccgcccgcctcggcctcccaaagtgctgggattacaagcgtgagccaccgcgcccggccagcagacatgaaatttgaactactgtgccatagttcagtactataggctttgaattttaaatggtacaaaatattcctatttacatgagatttgtgtaccacaataggctaaaagttttaggtttttttagagacagtgtcttgcaattttgtccaggctggacttgaattcctgggctcaagtgatcctcccacttgagcctcccaagtagctgagacttacaggcgcacactgcacccggcttaataggttaaaagttttaaagtaaatggcatttatttgagtcatcttatctttgatgttatggatctctgtcttcgtgtaaattatgtaacttctataaaataagatgtgccaattagaaaagaaagtggtaggaaaactggaatcatgtggttgatagtaagatgtcagggctttcctgataattaaaatatttaccaggtgaagactgctaacgctcaccaaaactcaacttccacaaaggaaataaccattctatcttcggattatcaaattcacaggcgtccagtacattgaccattatacattcatacatgacaaactgttgaccttcttgtgacagatgcttccgtggaaaaactaaacactgtgacactgctccctttgcacctactgtaccgttttcaaactgttgatgttactatctcccccattaggtgataaactcctggctcccagcaccgactcacaactactcagtttatttatttattttattttatttttattttattttattttattttattttattttgagacggagtttcactctgtcacccaggctggagtacagtggcgccatctcggcccactgcaacttccgcctcctgggttcaagtgattctcctgcctcagcctctgaagtagctgggattacagatgcacgccaccatacccggctaatttttgtatttttagtagagatggggtttcaccatggtggccaggctggtcttgatctcctgacctcaggtgatccgcctgcattggcctctcaaagtgctgggattacaggcatgagccactgcgcccagccactactcagtttatatttctttctttttctttttcttttttttttttgagacagggtcttgctcttgctctgtcatccagactggagtgcaatggtgtgatcagggctcactgcagcctcaacctcccaggctcgggtgatcctcccacctcagcctcccaagtagctgggtccataggcatgcacgccaccacaccctgataatattttttattacttttgtagatatgggtttttgccatgttgctcaggctgatctcgaactcctgggctgaagtgatcctcccactttggcctcccaaaatgttgggatcacagggatgagccaccgcaccccgccaatttatatttcttaagcccaaatgaaccacttttcttttttctgactttgatcctatctgacataatgcttagcccaatgtgaacaagcaggaagtttccataaagcaccagtcactgaggaaaaagtgctacctattcataagaaacttcggttcagattaccatgaggaagaatttaaattcctgaatgaaccagcaccttcgcaacttgataaactgggctttgctgaactaaaaagctttgcaagcacataaaggattttttcctcaaaacaattttattgtgttaagaatagtgcatgtaggctgggtgcagtggctcacgcgtgtaatcccaacacttttgagaggccgaggtgggcggatcacttgaggtcaggagttcgacgccagcctggccaacatggcaaaaccacatctctactaaaaatacaaaaattagcagggggtagtggcgggtgcctgtaatcccagctacttgggaggctgaggcaggagaatcgcctgaacccaggaggtggaggttgcagtgagccaggattgtaccactacactccagcctgggcgacagagcaagattccatctcaaaaaaaaaaaaagtcttccaactccagatacaagcgccatcaaaaagtgttatctgtgatctagcagatgactgttatctggacaagcacatagaaatgtcagagattctagactggcactgaccaatacagtagtcacatgtagctatttgaatttaaattaattaaaatgaaataaaatccaaaattcaattcctcatttagactagcaacatttcaagggcctccatggccattggtctcatactggataatgaatattttcatcatcacagaaagttctttgggatagcactgttatagactgtttcaaaggtctaatttacaccaaggatggaactatatagtctatatgtgactcagtagccagactaaatggaaagttggccccaggaatgagagaatgggagtaaaagtgtgtgagattgtatgtgcgtgtgtatatacatatatataaaacacaacataaatatataatatatatggaacttatatatatggaacaacataaatgtctataaatatcatatattcatagatacgtacatagtcaactcccaattcatccatttatctatataaaaaatatttattgaacatctgctatgtaccaagtattatactacgtgcaaggaaagcagatgtgaatgaccagtcccgggcctccaggagtttgcagtttgcagagaaggacaagccttagctagatgctgtggaacactagcatggctgcaaggggagctagccgtcctgaccacctgctgagctattgtctgcaggactcccatggtgtaggtttgtaggcacgcctccccccacacaaacattcacatgtgcaaaaacaaaacaagacaaaacttcacacacacactcaagaagccagttgtacgacatttgcaagtaaacagtaattagctaagattatcttatatcatattcattattctatacacagagctgcctatcatttgcagacttctgccagctgataattaagcaagtcttccatcaaaagctgtcaggttaaggggaaaaaaatcaaactaaaagtgtctcctgcatcgtcctaattgccaagacactgtgcatactcataacttttccgcctttttcctgctttcactttgcttcatctaagcccacattaaataggctattttttaagtctggtgtgttttttcctgatctgtttatttgtgctattaactgccagttattaagtgcctgtgccactgtaccaggcatttatacaaaatacctctaatcctcatagcaattatgtgaggtaggaattattattctcaatttatagatatggaaacggaatcagaggggttaaggaacttggtcaagatagataaatggtaaactgagatatcaaatcagggctgcctgactttcgtgcccgagctctttctcctgcaccaaaaagttggaatcattagaatttcccggccgggcagggtggctcacacctgtaatcccagcactttggaaggccaaggcgggcggatcacgaggtcaggagatcgagaccatcctggctaacacagtgaaaccccatctctactaaaaatacaaaaaattagctgggcgtggtggtgggtacctgtagtcccagctacttgggaggctgaggcaggagaatggcatgaacccgggaggcagagcttgcagtgaaccaagatcacaccactgcactccagcctgggcgacaaagtgagactcgatctcaaaaaaaaaaaaaaaaaaaaaaagagaaagaaagaaatcattagaatttagaatttcagagttataaatggcatactctgttccagccaaattttatgctatagagtcctgaagaaagagacaggcaaatcaatgattaaattacaagagtcatacgtgatagaggtacatattcagtacaggagatggagcaaggggcttattgggggcaaagggacttaagttgagtcttcaaagagtgagcagggctgagagagagggaagggcattccaggtaggaggaaccacctttacaaatgcatagaggcgaggcgcattcctgtggctataattcagtatgaatggacatgcttgcaggagcagggctaggaaattattatagtggacaaagaggtcgattaagaagaacccagccaagctaagaagttggagcttcatccactaataaagaggtgggtagtgaggggattaaagaatgttaagctgagaagtagctcgatcaggtctgaattttaggaagatcatgtaggcatcagagtgttgaaaatgcacatgttcacatatgtcgtaagcaggaaacataaataaatagcaacaggtgtaatagctgccatctaataatacatgacaaggtcatgcattggctccaggtcagtggtgccagagggagtgatggagattgtgagctggagtgagggcctctatggaaagggagcagtcgcctaggaccatctgcaaatgggacccaggattgtcggttttttgtttaagggaagtgggaaaatctttatttttatataatagctactgaattttagagatgaccaaacttatgtaggccaaaaacaaaaaaccacctttggtgatatgtttgtaagccttgggttaaagaatcttgaagggggcatgggccggaagaccagttaggaagttatttaaacaggtgagggccgggcatggtggctcatgcctgtaatcccagcatttttggaacgccaaagcaggcggatcacctgaggtcgggacctcgagaccagcctggccaacatggtgaaaccccatctctactaaaaatacaaaaattagccaggcgtggtggcacacacctgtaatcccagctacttgggaggctgagacaggagaatctcttgaacccaggaggcagaggttgtagtgagctgagatcacgccactgcactccagcctgggtgacagagtgagactgtgtctcaaaaaaaacaaaaatacaaaacaggtgagaagtactaaaggccactctgactcaggtcaaatggatcaattaatcttgagaagggtaaagagggctgtgaagaaagattacttaagattgctagggttttcttaaattccagtggtgttttggaccctcacatgaccatccaatcttggcaactataaccatttgggttaattctctaaacagtgctgccattagaaaggaaagggaggcccagcacggtggctcatgcctgtaatcccggcactttgggaggccgaggcaggcatattatctgaggtcggcagttcacgaccagcctgaccaacatggagaaaccccatctctactaaaaatacaaaattagccaggtgtgatggcacatgtctgtaatcccagctactcgggaggctgaggcaggagaactgcttgaatccgggaggcggaggttccagtgagccgagatcacaccattgcactccagcctgggcaacaagagcgaatctccgtctcaaaaaaaaagaaaggaaagggaatgttttgtggttgtgggcaccgtgcttactaagaagaaaaaggatgtacaatgtgcagatttttcagctttttggacaaatgtatatgaaggtattgaaccatgaagcagttcctttcatccccctcaaccaaaaagtggctgattcagatgaaaaggcacatgaattaagtcacagaaccaaagcaaaccttagcaacacgtgaggcttaggaaattgtttcttctcccctgcatctttataccattgaaataagattgaacggaacgccaaggagtgttctgaaacagagtgtagtcacaaagggaaacgttagtcccagaggagatgatgtgtggaaggaaggcacagtctcattaggtggatctggagagagagaaagagaattttacaacttttttggttgtaagcaagaagtagtgatgccatattctccactcaccatctccccgagtcactgcccagctgtatcatgtgttaattaattgtcatatgtataatttattattattattattattattattttgagacagggtcttgctctgtcacccaggctggagtgcagtggcacaatcatagttcacagcagccttgaactcctaggcttaagccatccttctgcctcagcttcccaagtagctgggattagaggtgtgagctaccacacccagataattaactttttttttttttttttttgtagagacaaggtcttgctacattgcccagactggtcttgagctcctggcctcaagtgatcctcccacctctgcctcccgaagtgccaaggttacaggtgtgagccaccatgggccatttatcctttattaaacatagaaatatctcattatctgatcccacagtgattctgagattgtatgaggataggccttacttattctattctgttttaatattcagtttagctactcaggaggctaaagcgggaggattgcttgagcccaggagttcgaggctgcagtgagctctgattacatcattgctctctagcctgggtgacacagcaagaccctgtctctaaaaaaactaaaaaaaaaacttctaaaaaaagattttgtttaggtgtcacctcctctaggaagattttccgaattacccccacgcatcctcaccgcccctgagtggattaggtgtgccctttctgagctcctaaaatctcagaatttttttttttttagacagtttcactctttttgcccaggctggagtgcaatgacatggtctcggctcactacaacctccacctcctgggttcaagtgattctcctgcctcagcctcccaagtagctgggattacaggcgtctgccaccacacccagctaattttgtatttttagtagagatggggtttcaccagtttagccaggctggtctcgaactcctaacctcaggtgatccacccacctcggcctcccaaagtactgagattacaggcatgagccaccatgcctggccaaaatctccaaagttattcttgccctgtggtttcattattttctctctctgtttctatttctcctactgattgaccttctaatgggggctcaagctagatgtctagtttgttttgtatccttatcgtttcctggagggtaagcactcaggacatgaaacatatggaatgaatgagcctgtgtagatccgacattgcttagtaaataactataccccttaccagccaggcaaagttgctcctttctctcagtctcagtcttttaacctgtaaaatgataattaccactgtcctgtctaccctgggggtgtaagaatcacatatgtaaaaattctaacctgtgaatgctatgtaattactacctacttataaacatatacttttggagaaaagggaggcagaagatttttttggtttttgtttgtttgtttgtttgtttgtttgtgtcagggtctcacccccatcgcccaggccggaatgcagtggcacaatcttggctcactgcagccttggcttcctgggctcgggtgattctcccaccttggcttcctaagtagctgagactacaggcacgcactaccatgtctgtctgattttttgtattttttaagtagagatggggttttgccttgctgctggtctcaaactcctgggttcatgagatccacctgctttggcctcccaaagtgctgggattacaggtgtgaaccaccatgtctggtttaggaagtttttttgttttttgtttttgagacagagtttcgctcttgttgcccaggctggaatgcaatggcacgatcttggctcactgcaacctccgcctcccaggttcaagcgattctcctgcctcagtctcccgagtagctgggattacaggtgcccgccaccacacccggctaattttgtatttttagtagagacggggtttctccaagttggtcaggctggtctcgaactcccgacctcaggtgatccgcctgcctcagcctcccaaagcgctgggattacagccacaagccactgtgcccggcctagaaagttcttttattgccaagcgtggtggctcacgcctgtaatcccagcactttgggaggccgaggcaggcggatcactgaggtcaggagttcgagaccagcctggccaatttggagaaacccctgtctctactaaaaatacaaaaattagccggacgtgatggtgcgcacctataatcccagctacttcagaggctgatgcaggagaattgcttgaatctgggaggcagaggttgcagtgagccgagatggtgccactgcactccagcctgggtgacagagcgaggatccatctcaaaaaaaaaaaaaaagaagaagaagagtgtagtgctttaaaatatgaagataaagtcactgactgcccatcaagtgggacagcttttcttctggtaatggggatacacctgtgcatcccactgtcacctgggactcctcagtgatccatgatttgacatgaagacactatcagctaaaaagcagggcagtctcagggtgcactttggaagtgcttaagggatctatattttgaactccagaaacggaacttccaaacttggactttatcacacctcctcaggcagccccacacttctataacaaacgagcttgaagcacactctctctcaagttatgatggataatattgcctaggcaatctaattaagcgcttggtaaacagaatcttaatttacacttagtccagaaggaacggcaggaatttatctcccttcccccagggaagacttgaattgacaagttgagggaggaaggccagttatattttaggcttatacattgtatctatcagagaagtgctatgatttcttcccaacacaggggaggtttggtgggctgcaaaatgggactaatttccaattttttccatttgtcagatcttcagaatctggttatactgttgtggtggtcgtggtctcaaactcctgggctcaagcgatcctcccgcctctacctcccaaagtgctaggattacagctgtagctgtgagccactgcgcccagcctggttatatcatttacttaagagaaatgtgaattcccagaacaggaacttcagacataaaaccaaagattttacaatgtaactactagtgatttttctatcacaggtggttcaaagttagtgtacatgccatcaacatgataataaagaatggcagagaaatgaatcatttgttaactaggggcagagtgattgatcttttaaaggctctgcttcacgctctgcagcggcttcccacggccctggaggtagagcaggaaccctcccctgggccctcctggagggaggtgtctcctgctacctctccagccttatcccaggcttctctgagcttcatcagggaagggatgaagggacccacttgttcccagagcctgcgttggtgtcctgcctgccatggaaatactcttggcctcctaaccctgactcagcctttagctctcagcataaccctgacggcccagaccaactaatgtcctccagactgagctttcctccccagtcacagcccacagctccctttccgtcgtgcttgttatactgggaactgttgggaacgtacacctacctcaaaggagtgcatcagtgcaaagggcctgctcatgggagcattctgcaaacattagctcttcaccatttgtttgtttgtttgtttgtttgagacaggatctcactctgctggagtgcagttgattgcatggcgcaatcacagctcacagcctcaacctcgcagactcaggtgatcctcccacatcagccttccaagtagctaggactacaggcattccccagcccgctaatatttgttattgtttttgtagagcaggggtctcactatgtttccaaggctggttttgaactcctgggctcaagcgatccatccgccttggcctctcaaagtgccgggattacaggcatgagccaccgcacccattggttatgtttgtctttctccctagattgtaccctctcatttattctataacccagacctcccacagtgaggactgtgctgaatcgcaggtgctcaataagtacttgttgaatgaaggactatataaaaattggttggccgggcacagtggctcatgcctgtaatcccagcaccttggaaggccaaggcaggcagatcacctgaggtcaggagttcgagaccaacctggccaacttggtgaaaccccccccccatttctactaaaaatacaaaaattagccaggcatggtggtgcacacctgtagctacttgggaggttgaggcaggagaatcgcttgaacccgggaggcggaggttgcagtgagccaagatcatgcgattgtactccagcctgggcttcaagagtgaaactctgtctcaaaaaaaaaaaaaaaaaaattggttgaatggggagtggggagttattatgcaatggtacagagtttccatctgggaagataaaaaaagttttggagatggaaggtggtgatagttgcagaagagtgtgaatgtctttaatgccatggaactgtacacctaaaacgggttaaaatatctattggacaagagattggtgtaaaaaaaaaaagaattaaaaaaatttttaaatggttcaaatggcaaatttcatattatgtgtatttcaccataataaaaaagtggctcatgcctgtaatcccaacactttgggaggccgaggtgggcagatcacgaggtcaggagattgagaccatcctggctaacacggtgaaaccccgtctctactaaaaatacaaagcttagctgggtgtggtggtgtgtgcctgtagtcccagctactcaggaggctgaggcaggagaatcgcttgaacccgggaggcggaggttgcagtgagctgagatagcaccattgcactccaaaaaaaaaaagtgctaaataaatgtataaataaatttgaaccagctcctatccgactctaatatttcaattcaataaacattcatagggtgcctgctcttggtaagacataaagtccactcttggacttatttaatagtatataaaatagactaaaaattgaaatccgattgcccttcgtgtgtaaaacatgttttaactagatagccaggtcttatttatctttataccccgagcagccagcacttaatatgtgcttaatatttgctaaatcgaaaatagtgcacagacaaaaattcagtatttgttcaggcctttccccattacaaaatgctcccacaaacaatacaacatttcctgttaccattaagattctttgactttcaccctttcttctctttccccttacttttgtgttttttttaatttgttttttttttttgttttttttttttttgagatggagtctcgctctgtcacccatgctggagtgcagtggtgcaatcttggctcactgcaaccaccacctcccgagttcaagcgattctcgtgcctcaggctcctgagtagctgggattacaggcatgtgccaccacgcctggctaatttttgtagttttttaagtggagacagggtttcaccacgttggccaggctagtctcaaactcccgacctcaggtgatccacccgccttggcctcccaaagtgctggtattacaggtgtgagccaccgcgcccggccttcatgttatcagccacgtcttcctgactttctgttgcctgaatcaacacatcttcttcaatttctttatcccttgtgttactattttcaactgcccatttctggctctcattccctgacatctcagcaaatgtttctattttatacctaaacagttacatttgactcggaggtggaaggcacattactagcgtaaaggtcagtttggcagaagccaattaggtcacatgcctgagaatcctgagagccatcgcccacctgtcgcaaaaccttctgggcatccttgacagcaagtatcactcatccagtttcaaaaaggaattgcacactgcttgtctactatctgtagtttaaatggtgatcatgtttcttcccttataatcaacttcaggctttttataaagaaaggaagtatagtttagataagcaacatactgtataataaaaaattaggaggcattataaaaagaagggaacaccaaaagtatgaggttaatcagagtgataaataatatttctgggcaggtgtggtggctcacgcttgtaatcccagcactttgggaggctgaggcgggtggatcacttgaggtcaggagttcgagacctgcctggccaacatagtgaaacctcatctctattaaaaatacaaaaattatctgggcatggtggcacaggcctgtagttccagctactggggaggctgaggcaggagaatcgcttgaacctgggaggtggaggtcacaatgagctgagatggtaccgctgcactccagcctgggcgatagagcaagattgtcaaaaaaaaaaaaaaaaaaaaaaagagagagagagaaaaagaaagaaagaaaaaaaggaaataatgttccttattttcaaggtctgatgtcatatggtagctactatcaggaggaaggacccctttaaacccagattttcaatgatagacaaggctatagtttgaatatgacccccaaagttcatgtgttgcaagcagaatccccaaagcaacagtgctgagtggtgggaactttaaaaggtgattaggtcatctgcgttcatgaatggattaatgctatgatctcaggactgggttccgttaaaaggatgagttcagcctctgtcttctctctctctcacacacacactcactctctgccccctctcttctctcttctctttctctcattctctcttgcccttctgtgataatgtggcaagaagtacctcaccagatgcagacctcaccagatgcccttcaacgttggacttcccagcctccagaaactatacccagtctcgatatctgttacaggacacaaaatggacgtagacaaaatagaaacaagtagagaggagacaatagtttcataagaagctgggagtctcatttggcttccatatgcctgatgcctttgacatctaggcaaaggtctcattctaatatccctagtagatttgacacagcacagcagttaagagcacagacttggccgggcggggtggctcacacttataatcccagcacttttcgaggccgaaggtgggcagatcacctgaggtcaggagttcaagatcagcctggccaacatggtgaaacccagtttctactaaaaataccaaaaataataataataataactgggtatggtggcagatgcctgtaatcccagttagtaccagactctggcgctgggctgccagaggaagaaacctttttcttttacttactagctttgtgaactcaggcaagtttcctagcctgtctatgcctcagttttctcctcattcaaaaaatgaaaacaacaagatataccatagagtttttgtgagcattaaataaattaatattcgcaaagcacttaaaacgataccaagttcctggcattgtatcaatgtttgataagtaaattacattacaaatatagttatctcacatcttagcaccctatagtttacaaattaattttggtatactagcctcatcaaattctcacaattccgaggaaggtattattaccttgatgtgtggatcaagaaataaagtttcctaagtgttttgtgaggttaatgatttgggacaaagttgaccagaaagaaaaataatttcatctattttatttctatgcttagttcaagggaaaagggtcagcaccttttctcccattttcatagcagagagcacggtggttaatcacttactttttctttggttaccgatatggtttggctgtgtccccactcaaatctcatcttcaagtgtagcgcccataatccccacgtgtaatgggagagacctaaagggaggtaattgactcatgggggcgggtctttcccgtgctgttctcatgatagtgaataaatctcatgagatctgatagttttataaagggtagttcccgggcagatgctctcttgcctgcgccatgtaaaatgtgactttgctgcttcttcgccctccgccatgattgggaagcctccccagccgtgtggaactgtgagtccattaaacctctttttctttataaatgacccagtctcaggtatttcttcatagcagtatgaaaatggattaatacagttactatgataataagtagaataccttccattgaaacatagtttgtatatgtgtatctgtgatatgtgacatattgcatgtatctcttccaagaaagttttcctattactaagtcctttattactaaggacctttggggaacaatagtaatttcatacatattagttttaatggtgagtgttacacttatgctcaacttctcggctgaagttcagtctttgcctgtagagggaagctcactgtagactctggactgagtcttcctcttctccaacacacaccagagttatggaagaagtttgttttctgctctgcagtattggtatttcctttttccctttttttcttttcttttcttttttttttatttttatctggagacaaagtctaactctgtcacctaggctggactgcagtggtgcgatgtcggctcactgcaacctccacctcccaggttcaagtgattctcctgcctcaccctcctgagtagctgggactacaggcacgcgccaccatgcccagctaatttttgtatttttagtagagacagggtttctccatgttggttaggctcgtctcgagctcctgacctcaagtgattcacctgcccctgcccccaaagtgctgggattacaggcgtgagccaccacgcccggcctcttttcttttcttttctttctttttttttgttttcaatagagacagagtcttgttatgttgcccaggctggtctccaactcctggcctcaagcaatcctctctcacctcagcctcccaaagtgctggaattacaggcatgagccactgcacccagccagtatttcctattttaaacaggatactatgcatgggcaaaggttctcagggtagctggacaaaccggagaggcaggattgccttcctcctcaggtcttgggtgctcctagacacagcagagtggtgtcaagcacacaggtttgggaatgaggagctgaactgtctgggattgaattccagccgtacaattttctagctgtgtgactttcagcaagacaatcattctctctccatttcctcatttacgacgtggagatattgacagtatctaccttattggattattgggaagattacgtggttaatgccagtgaagcccttagaacactaggcccagctggctcatacaaacattccgtaaacgttatctattagtattatgtcctattttgcttaacacactcatcatcctgtcgtctaagtcaatagctttcaaacatttttgcccgtgacttccagtaagaaatatattttggccatgcacggtggctcatgcctgtaatcccagcacttggggaggctgaggccggcggatcacaagatcaagagattgagaccatcctggccaacatagtgaaaccccgtctctactaaaaatacaaaagttagctgggcgtggtggcatgtgcctgtagtcccagctacttgggaggctgaggcaggagaatcatttgaacctgggaggcagaggttgcagtgagccgagatcgtgccactgcactgcagcctggcaatagagcaagactctgtctcaaaaaaaaaaaaaaaaaaaagaaagaaatatatttacatcacaatcgactacatacacacataaaaaaactagattgaagtttcacaaaacatgaatactcttactaatacattgtactgtcttaatttctattccccttttaaaaatggtggtgcattattaaattgatttcacgacccgataatgggtcagttagaaaaactgggctctttgataggctattcactaggctgaataatgacccctgagatgtccatgtcctaattcctgcaaaagggactttgcacatgtgattatggttacaaaccttgagatgtggtgattctcctggattatccagctgggcctagtctgtcaacgtgagtccttaaaagtggagaaccttttctggctgtgatcagatagagaggtgaccatgaaagaagggtcagagatgcagaaggaaaaggactcagtcggccattgctggctttgaacatggaggaagggggccacaagccaaggaatgtggatagctgctagaaaatggaaaaagcaggaagacagattccttctgagagcccctagaaagaaacacagccctgcaacaccttaattttagcccagtgagacccctctcagacttctgaccaccacaattgttagataataaatttatgttaagacactagatttgtgataatttgtcccagtagcaatagaaaactaatatattatgtaagccagaagccttgactttactgtttccctagacttttcttttttcttttatttattttattttattttattttgagacagaatcttgctctgttgcccagtctggagtgcaatggcacaatctcagctcactgcaacctccacctcccaggttcaagcgattctcccacatcagcctccggtggagctgggattataggcatgcaccagcgtgcccagctaatttttgtatttttagtagagacagggtttcaccttgttggtcaggctggtcttaaacttctgacctcaggtgatccacctgcctcagcctcccaaagtgctgggattaaaggtatgagccactgcactggcctagacctttaatttaatggtctttaatgtcattaaatttaatgccacctagtcctcttgcttctatctttgaatatctctgaaaaaatccatatgtttccccaattttcatggctcttgccctcattcagttcctatttatctctattttgaattattcctacttctgggcccctatctgtgctacatcctcttccttctggctttcagagttaagttaataaactaccaatatgattacctcttggcactttttttggggggttgggggagttggagtcttgctctagtcgcccacactggagtacagtggcgcgatctcggctcactgcaacctccacctcccgggctcaagcgattctcttacctcagcctccgaagtagctgggattacaggcacacatcaccatgcccggctaatttttgtatttttagtagagacggggtttcacaatattggccaggctggccttgaactcctgaccttgtgatccacccgcctcagcctcccgaagtgctgggattacaggcgcgagccaccacgcctggccaggcactttgttttttttaagagattggggatgggggcaccttgctatgtcgcccaggctgatcttgaactcttaacctcaaaccattctcccaaagtgctaggattacacgtctgagcctccacgcccagctcttggcacttctgatgcctcaacatgcttccagaataaaatctgaagtcttcagagcaatcgccaaagctttgcggatgacccagttcaaatctatgaggacacatttctctgctgccattttccccattctggcctcttagagtattatatttataaagttagttttccatgtcactttattatagttggttatctatttttttggttttaaaaaatgtgcttcctcagggccaaagaagccacaaagaatatgccctgcctgccagtcagtcagctccacctgtgtgcccgtctaaggcctcatttattatgtatatagagtatggctctccaatcacaatgtgctttattttttaattagggctttagtggccaagagaactctcttttccatacttgagcaaaataaataaatcaatcaggagtgcattttttatctgcatcttttattttaataaatctcatcaaaaatttgtatcaacctatgcatttgaacggtcttgctagacctaacatcaaaacgtggatgataaatgcatgaaggagccgggcacagtggctcatgcctgtaatcccagcactttggaaggccaaggcaggcagatcgcttcaggccaggagtttgacatcagccaggtcaacatggtgaaaccccgtccctaccaaaaataaaaaaattagccgggtgtggtggcgctcacctgtaatctcagctactcaggaggctgagacaggagaatcacttgaacccaggaggcagaggttacagtgagccaagatcgtgccactgcactccagtctgagcgacagagtgagactccgtctcaaaaaaaaaaattacttctttaaaggcactatctccaaatagagtcacattcttaggttcttggtgttgggatgtcaatatatgaattttggagagacataattcagcccataatgaatagtgaggatatcacctcctaactcagctttgcgcatacacagagttctaacaaatctcttctaggtgcatcttcaagcccctgttacgatcctcctatttgggtactacatttccattttcctatctcaaggctgagttctaccctgcagccctaatttgggctcaaaaggaattccgtcttttcctatggtccctcacacacccatcccttgttctttggttataacccctccacctgccacagcctcaccaccaactcagcttgcccagcactgccaaaaaatttttccccttctttctgacgtttcggacttggattcttttgaaaactatcctgagcccttatatttgcaatggaattttttttcttttttttttttttttttttgagacagaatcttgctctgtcgccgaggctggagtgcagtggcgcgatctcagctcactgcaacctctgtctcccaggttcaagtgattctcctgcctcagcctcctgagtagctgggattacaggcacctgccaccacacccagctaatttttgtatttttagtagagacaagatttcgccctgttgcctaggctggtctcaaactcctgacctcaagtgatccacctgcctcagcctctcaaaatgctgggattacaggtgtgagccaccatgcccggccttgcaatggaatttctgagagatcgtgttccactcttgcttcccctttcttccctctatgccctgcatttttaaataagtaactttaggccgggcacggtggctcatgcctgtaatcccagcactttgggaggccgaggcgggcggatcacgaggtctggagatcaagaccatcctggctaacgtggtgaaaccccatctctactaaaaaatacaaaaaattagctgggcaaggtggtgggcgcctgtagtcccagctactcgggaggctgaggcaggagaatggcgtgaacctgggaggcggagtttgcagtgagctgagatagcgccactgccctccagcctgggcgacagagcgagactctgtctcaaaaaaaaaaaaaagtaactttaatgttattaatattattattttttttgagatggtgtctcactctcacccaggcttgagtgcagtggtgtaacctcagctcactgcagcctctgtctcccgggttcaagtgattctcctgcctcagcctcctcagtaactgggattacaggtgtgtaccaccatgcccagctaatttttgtatttttagtagagatggggtttcgccatgttggccaggctggccttgaactgctgacctcgaactgctgatctcaggtgatccgcccacctcggcctcccaaagtgctgggattataggtatgagccaccgcgcccggccaaaagtaagttttagaattactcaactcctgctaggcacagttatgtagattccactaatggtcacataacttgagtccagattctcaggtgcattatctgtccaattagaaagttgtaaagatcattttcaacgaagccagcaggaacacctttcattaaacatttcaagtatgtaatgtggggaggctcttcctcttcttcctcctgtttctatttgcagtttatgtttttttgcatgaggcattcttgcttcatggaccaggttcaaacttgaccaatatacctgaccacccagaatctgtgtcctagtcctcggctgtggtctgggaatagcggtagctcctcggaaggagtgagtcagtggcagagtgatgcgatgtgctggcaatggggatggatttgaagaccagtggctcatgccttgagctatcacaggcccaagttcagtgtcctctcctgggaaacttggtggtttgtgcctgtgtatgttgagagtaggcaagggtagcattcctgatctaggcagagccttatttgaaagacttctgttttcatttttgttttattttagtttggagtgtgtgtgtgtttgtgtgtgtgtgtgggtgggtgtgtatatgtgtgtgtgtgtgtgtgttttaagtggacattaaaaattccaagcctggctgggccgggcacggtgactcatgcctgtaatcccagcactttgggaggccgaggcgggcggatcacgaggtcaggagatcaagaccatcctggctaacacagtgaaaccccgtctctactaaaaatacaaaaaattagccgggcgtggtggcgggcgcctgtagtcccagctactcgggaggctgagggaggagaatggcatgaacccgggaggcggagcttgcagtgagccaggatcgtgccactgcactccagcctgggcgacagagcaagactccgtctcaaaaaaaaaaaaaattccaagcctaaggcagaatcaccctgaaggatgctaagtgcaactccaattccaggatctgctgtctaaaaatacaaattccattttcagacacacgaagcatcatattagacagcaacagtgtctgctttgatcttggttagttgagattgatcatttgcattcaaagttcatattaatattcaggctaacaggtaaagctagcatgctgaggttggagagccagcccacttgttaactattataattgagataggctgtggtcattaatgtaaatgacagtgactccccttggtcttctggttagtaataaagaaaagagctctgaatgaagatcaatggatctgattcaaatcccagccctaactcaaacattctcttaacctctctgacagcattctcctcttttgccaaaggatcataagaatagcttctatatgcactaaacttgtatttaagatttttttatcattttataaaaatgatacacatacactgtttaaatagtgagatagtactataaggtttattacaaaaaacagcagttccctgcctgtgacagattgtattttccaaagatggctacaatatctcccagctcacaatgcttttcttccaatgagaccatgacatttctcccacagaatggagtagggggctctgtgtttcctcccctctaacctgggtggatcttggtgactgctttgaccgatagagcatggcggaagtgatgctgtattcatcagggttctccaaagaaacacaaccaataggagatagctacatctctctacgtatttattttgagacagtgtctcactctgtcacacaagctggagcgcagtggcacgaccatgcttccctgcagcctcaacttcccgggctcaagcgatcctcccatctcagcctccttagtagctgggactacagacacacaccaccatgcctggctatttttttttcttttttatttttttgcagacagggtttagccctgttgctcaggctgatctctgaactcctgaacccaaggaatccacctgcctcagcctctcaaattgctgggattataggcatgagccaccacgccagccaggatgaaggtattctactctctttctctttcttttttttttttgagacgcagtttcactcttgtcgcccaggctggagtgcaatggcacaatcttggctcactgcaacctccgcctcccaggttcaagcgattctcctgctttagcctcctgagtagctgggattacaggcgcccgccaccatgcccagctaattttttatatttttaggagagacgaagtttcactatgttggccaggctggtgtcaaactcctgacctcaggtgatccacccgcctcggcctcccaaagtgctgagattacaggtgtgagccaccgcgcccggcctctactctcatattatcccagcctgccacttctacttcctcaaccctgcaaacataattatatcaagatattggttaagccaatatttattattgaccctattatttctatgtgagtgttgttcactgttgagctaagtaatgcattcgcattacattctctttcttatactatttaatttcccatttgctcaatttcccatgtcattattactatttctttccacattctccaactgaattgcaaaacccccgcataagattttctacgtggtcaaacacacatgaaataatgtagctatcagtgtccattttcccctggacttcagggccccagttcctttctggactggctctctctgggtgtagctgccgtctggaggcccctttcacctttctcctgggtcagatccctttgtcctgactgtggtcctactcttcagtgggttatcccctcattctggtggagtgtagcctctggtggctctggaagaaggtgcccaggaagtgaaaatgtcttttttttttttttttgagatggggtctccctctgtcacccaggctggagtgcagtggctccaactctgctcactgcaacctccacttcttgggttcaagcaattctcctgcctcagcctcctgagtagctgggattacaggtgcgtgccaccatgcccggctaatgttttttgtttttagtagagacggggtttcagcatgttggtcaggctcgtctcgaactcctgacctcgtgatccgcccacctcggcctccccaagtgctgggattacaggcgtgagccaccatgcctggccaggaggtgaaaatgtctttattttactctctcatttgattaatggtctggtgaggcagagaattctaattcaaaaaattattttttcctcaaaatattgaaagcattgttttgttgtctgccagtttccaatgctgttcttgagagttccactgccattctgattccagaatctttatgtgtaatatttattttttgccttctatggattaatgttttctcttcatctccagtgttccgaattttttttgttgtttgtttttgagacagggtctcactctgccacccagactggagtgcagtggcacgatcatagctcactggaacctccacctcccaggctcaagcaatcctccgcctcaggctcctgagaaggtgggaccactggcctgcaccaccacactggactaactttttgattttttgtatagatgaggtctcaacatcttgcccaagctgctctggaactcctgggctcaagtgatcctcccaccatagcctcccaaagtgctcggattacaggtgtgaaccaccgtgcccggcctcttctgaaatattatgaagatatgacttagtgtagatcttttcattaatttttctggataggccctttgaatctagaggcccactctcctgagtttttttttctttggtaattttctcttctctatattctacttattaaattcctggccgggtgtggtggctcatgcctgtaatcccagcactctgggaggcagaggagggcagattacctgaggtcaggagttcaagaccagcctggccaacatggtaaaaccctttctctattaaaaatacaaaattagccaggtatggtggtgggtgcctgtagtcccagctactcaggaggctgagtcaggagaattgcttgaacccgggaggcagaggttgcagtgagccgagatcgcgccattgcactccagcctggggcaacaagagtgaaactctatctcaaaaaattaattaattaattaattcctattagttggctattagactatctggataatcctttattttaaattattttcttgcttgtcgtccatttatttctatattatgggaaattgcctcatttcccataaaatttgctgtcactttatcttatctctctctctgagaacagcaatttcatctatttctggaagtgtttgtccatgtcctgcattgcctttttcttcaaaattttccccatcattcgtttgtttattttagtccttgtctttcatacgggatcatggaatgcccagcaatccttgtaggaccattcacattaaacagtgactcactacaaagctgagaggaaacatgagcaaggcttggtaatgttgaacttcactccagggtgatagggtcatgcctgttcagagagttattttctttttctttcctttctttctttctttcttttttctttttttttgacggaatctcactctgtcaccaggctggagtgcaatggtgcgatctcagttcactgcaacctctacttccctggttcaagcaattctcctgcctcagcctcccgagtagctgggattacaggcgttggtcaccacacccagctaattatttgtatttttagtagaggcggggtttcaccatgttggctaggctagtctcgaactcctgaccttaaatgatcttcccacctcggcctcccaaagtgttgggattacaggcatgagccaccgcgcccgggtatttatttatttatttatttatttattttagagacagtgtctcactctgtcacctaggctctcactgcagcctccatctcttggcctcactcaatcctcccactttggcctcgcaaaatgctgggattacaggcgtcagccaccacgcgtggcccagctatttaatattttaacggaacagtttttccaagaaaaactcattcttctacctgagaacaggggtggggctaccatacactctgaggacaagcagggatagggcctggctgcatttcatgtagcccctcttgctttcagcccagtgcctcgtccctgccttccagaatgtcagctgttcccgaatctggacccctgcagttccatttccccaaaaattagcttctggactcgtgccggcagggcgggggcagggtggaggggaggagtgttcacctggctatgtggagaggtggagggaacatgatgggaactcttccacaggtttggaaccagtttccctgtttccagccccacttggcagaacctgtctctcgcagtccgagcctttaacggttttttgtgtacatcagcatcctcctctgatctggtgccgcttccctgctatgtgagttactcgcttcttatgacttccgtagtctcaaaatatactgctgtcattcactgtaatattctcttctgttctctttgatgctatgggtttagactcattttatttcttttctgtcattttagtagaccccaggaagccatggagacaaacattgtgttgactctgctgtgtttaatcagcaatctccctacctacttggtaagattatcatcagtatcaacttggacaatatatgcaagtgctttgcaagctctaaaatgtcatccacgtgtgatttactatcatttgatccctaagacacctcgagagatttttttctgctgtgacttttctcttgctacttttgacaaaacgagcacttcagtgctggcagctgtccatctagcaataatctttaaggtcccaaacaagatgaaaatgactaaaacgctcacaattgtatgtgttatacaaaagaagttgaaaatgccatactgaatggtaggctaaatgaaatgtactatgctagaatttccagcaaaagtctcttaaaagctgggtgcagtcatgtattcctgtagtctaagctacttgggagattgaggtgggaggatcatttagggtccaggagttcaagaccagcctgggaaacatagcaagaccccatctctaaaaaaaaaaaaaaattctttctgctccgctcacccacaaaacccccaggtaagtgcgctacttgcccctgtgctccacaggccctgtgcacagaactcttacaccactgcccactctgtggaaattgtttatttcttgttggttgcaccctctggttatgggttatgtcttactcatctctttatccccagcacctagtagagtgcctggaatacagtagctcctcaatatttaatgattcgaaacactgcagacaaccgcattcaaatagtatcccgtttttttgggaaaatgcttctaaaggggatgaccagatattccacttgaaatgttaagaaaacaaaaattggaaattctttctcctttttttttttgagacagagtttccctcttgttgcccaggctggagtgcagtggtgcgatctcaggtcacggcaacctccgcctcccgggttcaagccattctcctgcctcagcctccagagtagctgggattacaggcatgctccaccatgcctggctaattttgtatttttagtagagacggggtttctctatgttggtcaggctggtctcaaactctgcacctcaggcaatccgcctgcttcggcctcccaaagtgctgggatgacaggcgtgagccgccgtgcccagccttctttctcccttataaagacaaaggaggctgggcttggtggctcacatctgtcatcccaacactttgggaggccaaggcaggtggatcacctgaggtcaggagtttgagaccagcctgaccaatatggtgaaactccatctctactgaaaatacaaaaatcagctgggcgtggtggtgggcacctgtaatcccagctactcaggaggctgagacaggagaattgcttgaacccgggaggcagaggttgcagtgagctgagattgcaccactgcactccagcctgggcaacagagcgagactccatctcaaaaaaaaaaaaaaaaaaaaaaaaagacaaaggagaacattttggatctgtctgacagcttgcttcatcttttcatgcaatgggagaagaaggatagagaaataaaactccagttctggcagcaccagacagcccagacacaagtgttaagcacaaaaggagaggcagcatggatcctggcagctcttgtgttgcatgaaaaacacctgctctgttggcagccaggagagaaaaaccagaatagcacaggctcacccactcacgaaaacacaggaactcccctgtatgtaggcaagaggggctggggagcatcagcagacaggcctagtgaagcttacctggaaaatgtaccctatactctttaaaaggacttgaatttccttcagaatgagaagagaatgaaattcaacacctttctttcttagaggcagctaggcctgatcagagcccacaaggttgcaagcttgccggaagcttgactcagccaggactagccacacacgaatgaggcctggggccagaatcgcccctgggggaggctccctcggccacactgtgaggaaattgctgaggaacatgccatccactctgctgggggtaccccacagtgggcattgcactcagagttctgggggaatggggcaagatttggagataacagtattgagaacactgagggcagcaaccaaaataagcaagcaaggagacctacaaatcaggaaacatggcgacagggaaggcctgagccatgaagaccacggtattaacccgcgaggatgaccctcttgtatcttcaacatcatgtgtccaaaatagccctttgagatgttccttaagaaaagcgttcatgggcccggcacagtggctcacacctgcaaacccagcactttgggaggctgaggcaggaggatcacttgaccccaggagttcgagaccagcccagggaaaataaggagtcccccatctctaccaaaaaaaaaaaaagacacagagagaagagttctaccagaaaatcaataccacatgttttcacttgtaagtgggagctaaacactgggtctgtacagacataaagatggaaacaatggacactgggcactccagaaagagggagtggggaggcagacggggttaaaaaccacttcctgggggccctgtgtccacagtttgggagacaggttcaataggagcccaaacctcggcattatgagtatatccatgtaacaaatctggacatataccccttgaatctacctttttttttttttttttttgatggagtcgcactctgtcaccaggttggagtgcagtggcacaatctcggctcactgcaacctctgcctcccgggttcaagtgattctcctgcctcagtctccagagtagctgggactacaggcgcgtgccaccacgcccagctaattttttgtattttttttagtagagacggggtttcaccatgttggccaggatggtctcgatctcctgacctcgtgatccgtccgccttgggctcccaaagtgctgggattacaggcgtgagccactgcacccagtcctaatttttttttttttaattaaaaagaaagggttctatggtcacagaaatttgggaaatgctgcctgcaataaacccccatagggatttacaatgaacagtaacctctggaaggccctgagcagttcttcaagaaaggaaaaagacaaaaacagaaaaaatgacacctggatttcccactttccttcaagcaaggcctgttaacatcctgcagaactagtgttccagggaccataaaatggtaactgctgttctacccagccttgacagttgaagctcgtctttagcaatgacacaactttcagaattttgtagtgaaagatacgttttgttataaacattagttgtgaatttttaaatccttttttctcaagtaacatctcacagcggaaaatccaccatgtttctgaaatgttgttttgtttttccaattaacttttttttatatagactcaatttgtttagcactgtttgggcaaaactgagcagaaagcaatgttcccagatgcctcctccccacccctccccctcagactcccccatatcaacacatagagtgccccacagtggcacattcttacgaacaatcaacgaacctgcacagatagtcattatcacccaaagtccgtagttcacattggggttcactcttggtactgtgcattctatgagtcttgacaagtatatgatgacacgtatccaccagtgcaataatatacagagtcgtttcactgccctaaaaatcctccgtgttctgcctgttcacccctccctcccactaacccctggcaactaccaaactttttactgtcatcatagttttgccttttctagaatgtcatataattggaatccttataatgtttttgtttttgttaaatcttatggtatttctgtgtaaaaggaaattaaagagagagagagagaaataacaccccttccatggaagatcactggctcattctttactttataacagggtttctcaaccttagcactattggtgttttgcaccagataattctttggtgttgggcagggaagggggtgttgtcatgtgtggtttatttttttttttttagatggagtctcgctctgtctcccaggctggggtgcaatggagagatgtcggctcactgcaacctccacctcccgggttcaagtgattctccggcctcagtctctcgagtagctgggattataggcacccaccaccacgcccggctaattatttgtatctttagtagagatggggtttcaccatgttggccaggctggtctcgaagtcctgacttcgtgattcacccgcctcggcctcccaaagtgctgggattacaggtgtgagccaccgcgcccggcctgttttgtgtattttataggatgttcagtggcatccccagcctctatccactatataggaaggaccaccttcccaagttgtgaccatcaaaaacatctcagacattaccagatgtcccctggaagcgaaatcattcggactgagaaccactggtctaaaggagacattcaaacttcatcagaaaatctcacaaatattttatatgtagtcatttacctctggtaagcatttggccacctaaaatgtttggtaagggtcgggcacagtggctcacgcctgtaatcccagcactttgggaggccgaggtgggcagatcacctgagatcaggagttcaagaccagcctggccaatgtggtgaaaccccgtctctactaaaaatacaaaagttagctgggcatggtagcaggtgcctgtaatcccagctattcaggaggctgaggcaggagaatcgcttgaacccaggaggcagaggttgccgtgagtggagatcgtgtcactgcactccagcctgggcaacagagggagactccatctcaaaaaaaaaaaaaaaaaaaaaaagccttggtaaggagtaggaaaatgaggtatagagatcaaggagttgcagccgaaatctacaggatgaccacgaatatggacttttaatctcacacaacaaactgtattattctttaagcaaaacagcacataagcaaatcagataataaaagttttttttttttttaaagagattttctccttgaaaccttgttaaaggaaaatacttgaaccctcgttttggggttgttttcatgtcgtctctagatctgaaaagagtttgatcctgttcagatgttctttaaatgttcatagaaggtaaattcttgctctctttaagaattaaaagctaatacttgacataactttcttagactataaaatacatctgataaaagtctactttaaaaaaagcatttgctgggtgtagtggctcatgcctgtaatcccaggactttggtaggcctaggcatggtggctcatgcctgtaatcccagctgcttgggaggctgaggcaggagaattgcttgaacccgggaggtggagattgcggtgagccaagatcacaccattgtactccagcctgggcaacaagagtgaaactccgtctcaaaaaaaaaaaaaaaaaaaaaaaaaaaaaagcattagaggccggctgcgagtttcatgcctgcaatcccagcactctgggaggccaaggtgggcagatcacttgaggccaggagttcaagaccagcctggccaacatagcaaaacctcgtctctactaaaaatacaaaaaattcactcgacatggttgtgtacgtctgtagtcccaactgctcgagagactgaggcaggagaatcacttgaacccgggaggcagaggttgcagtgagccaagatcatgccactgcactacagcctgggtgacagagcaagaccgtctcaaaaaaaaaaaagggttagaaatttagagtgagatacttctgctccaataaactgtggcccaagcgtgtgagaccacatactaaaaacaggccaggccagacacggtgactcatgcctataatcccagtgctttgaaaggctgaggtgggaggatcgcttgagttcaggagttcgagactgacctgagtaacatggggaaaccctgtctctaaaaaaaaaaaaaaaaaattaaaaattagccaggtgtggtggtgcatgcctgtagtcccagctagtccagaggctgaggcaggaggaaggttgcaatcaggagttcgaggctgcagtgagctatgatcatgccagcgtaggcaacagagcagggataccccatctcaagaaaggaaggaaggaaggaagaaaggaaggagcaaacatcccaaaaggtagtttgagaagagggggaactcttacaatgtcacttaccagaatagaccaacagcaattttttagtgacatgcttttgattttagtcccaaatccctagtttttattgaatgtggccagcaaagccctgcatggtgtgatccctgcccacccagacagtctctctcacgtgactcctcccagccccaccccacttctcagtcagattggacttcttgccaccgcagggtttttacctctgctatttccactgcctggcaccatttcttcctctcatccttatcctgtctcagcctattcagtcttagtccattcggggtgctataacaaaatagcataactggccgcttacaaacaacagaaatgtattatctcagaatgctgaaaacagaaaagtccaagatgaaggcgctggcaaattccgtgtctggtgagtgcacacttccggttcggagacggcaccttctcactgtgtcctcacggtggaggggactgggggctcgcagggactcttttttttttttttttgagacggaatttcgctttttttgtccaggctggagttcaacggcgcgatctcggcgcgctgcaacctccgcctccccggttcaagcgattctcctgcctcagcctctcgagtagctgggactacaggcgcccgccaccacacgtgactaattttttttttttttttttgacagaatttcgctctgtcgcccaggctggagtgacagtggcgcgatcttggctcactacaagctccgccttccgggtcacgccattctcctgcctccgcctcccgagtagctgcgactacaggcgcccgccaccgcgcccatctaattttttggtctttgttttagtagagacggggtttcaccgtgttagccaggatggtcacgatctcctgacctcgtgatccgcccgcctcggcctcccaaacgcccggctactttttgtatttttagtagagagtttcgccatgttggtcaggatggtctcgaactcctgacctcaggtgattcacccacttcggcctcccaaagtgctgggattacaggcgtaagccaccgcgcccagtttcctttcaacttttctcaaggatcttccttcagactgagggctgtgtttctggccctagcccttgaagttttgttgttgtttttttcaataatcagtagttctgaacatttcatttcccagtttctgtgttctttctgcccaaagctaaattctaatatttcagtaaatattttcactggttctggcagcatagtattttatcatgtgacaatgccactgtgggtttatagaaccattcgttccctgttgaggggcatttatgttgtttccaactttctgatattatggtgaaatgccacagtggggatactcgtaacctaaattttcccacatgtctgattattttctcaggataaatttctaaaaagaactgctaggctgggcatggtggctcacgcctgtagtcccagcactttgggaggccgaggcaggtggatcgcttgagcccaggagttcaggaccagcctgggcaacatgcaaaaccccatctttacaaaaaatacaataattagccaggcatggtggcatgtgactacagtcctagctactcgagaggctgaggtgggagaattgcttgcgcccagaaggtggaggttacagtgagtggagatcgcactactgtactccagcctgggggacagagtgagaccctgtcttgaaaaaacaaaaaacaaaacaaacaaaaaaaacctactaagttaaagggtaagaacattttttaaggctaaaggcatattttgtccgttttgtcccattacattaggcttgcttttgacacttaactcagtggtcacgagagttttcctaccaactctcctcccactatttactttttctgtgtcagcttcttatccggtttcatctgtctgatttcctgtattcctttttttttttttcttttttttgagatggagtgtcgctctgttgctcaggctggagtgcagtggtgcgatctcagttcactgcagcctcccgggttcaagtgattctcatgcctcagcctcctgagtagctgggattacaggctcctgccaccaggcctggctaatttttgtatttttagtagagacagggtttcaccatgttgcccaggctgttctaaaattcctggcctcaagtgatccgcctgcctcagcctccccaaatgctgggattacaggagtgagccaccatggcagtcctaacactgcttgattttatgtctcattaatcttcgcattgacttgttcattaaataagtgcggagcccccatgctgtgccagcagttgtgcttggctaagtgcagtcaacaagatgatcaaatcataacagaatgtggtcagtactctgtggacactaacataaccctaggaaataattataggggaaaggttgacttccgaaagtttgttaggaaagttattttttatttttacttatttacttttgagacaggggtctcactatgttgcccaggctgtccttgaacccctggactcacgcaatcctcctgcctcagactcctgggtagctgggattacaggcgtgcaccaccatgctccgtgaaaagttctttctgagaagatgaaacctgaagaataagaaggaaccaactggccaatgagcaagcacatgaaaagacgctcagcatcattagtcattaggaaaatgccaatcaaaaccacaatgagatagcactcataacacccactaggatggctataattaaaagaaaagggggaggaggaataacaagtgttggcaaggatgtggagaaataggagcccttgtacagtacttatggggatacagattggtgcagctgctgtgggaaagtagttgagcatttcctcaaaaagttaaacctagagttaccacgtggcccagcaattcaactcctaggtatgtatccaagagaactgaaaacatatattcacacaaaaagttataaacaaatgttcacgagagaattattcataaaaggtcaggtgcagtggctcacgcctgtaatcccaacactttgggaggccaaggcgggtggatcacttgaggtcaggagttcaagacgaccctggccaacgtgatgaaaccccacctctactaaaaatacaaacaaattagctgagtgtggtggcaggaacctgtaatcccagctactcaggaggctgaggcaggagaatctcttgaacccaggagacggaggttgcagtgagccgagatcacgccactgcattccagcctggggaacagagtgagactccatctccaaaaaacaaaagaggaattattcataaaagtcaaaatgtggaaactactcaaatgtccatcaactgataaagaaaatgataaagtcatacaatagaatattcttcagccataaaaaggaatgatgtgctaatccatgctacgacacaggtgaacctacaacattatgctaagtgaaagttgccagaaataaaagggcacatattgggattctatttatacgaaatgtccaaaagggacgaatctgtaaagatagaagtagattagtaggttttgtttgtttgtttgttttgtgacagagtctcactctgtcgcccaggctggagtacagtggtgcgatctcggctcactgcaacctctgcctcgggttcaagcaattctcctgccttagcctctgtagtagctgggattacaggcgtgcgctaccacgccccggctaatttttgtattattagtagagacagggtttcaccatgttggccaggctggtctcaaactcctggcctcaaatgacatgcccgccttggcctcccaaagtgctgggattacaggcgtgagccatcgcgccaggcctagaagcagattagtatttgtataggttgcaggaggggaaaacggagagtgactgcttttaatgagtatggggttttgggagccgggtgatgaaaatattttggaattaatagtggtgacgttagtggatgactggatgcaggaaaaaaaaatagtggtgatggttgcacatcattgtgagtatgctctaaaaaacaataaccactgaattgtacactctaagatggttaaaatggtgaatttgttatgtgaattattattattattatttttgagatggagtttcactcttgttgcccaggctggaatgcaatggcgcaatctcggctcactgcaacctctgcctcccaggttcaagcgattctcctgcctcagcctcccgagtagctgggattacaggcatctgccatcatgcctggctaattttgtatttttagtagagacagggtttcaccatgttggtcagactggtctcgaactcctgacctcaggtgatctgcccaccttggcctcccaacgtgctgggattacaggtgtgagctaccgcacctggccgtgaattattttgtattgagatgcaatcacatgacataaaagtaaacatttctttttttttttttttttttttttgagacagagttttgctcttgttgcccaggctggagtgcaatggtgcgatctcagctcacagcaacctctgcctctcaggttcaagcaattctcctgcctcagcctcctgagtagctaggattacaggcatgcgccaccatgcccagctaattttgtatttttagtagagacggggtttctccatgttgaggctggtctcgaactcctgacctcaggtgatccgcccgcctcgacctcccaaagtgctgggattacaggtgtgagccaccgcacccggccaaaattaaccatttctaagggtgcagttcactggcatttagtatatccacaggaatgtgaaaaaaaaaacaaaaaactacacttaaatgtaatatgcggactgggcacgctcatgcctgttattatcccagcactttgggaggccgaggcaggcggatcacttgaggccagggtctgagaccagcatggccaacatgataaaactgtctctaccaaaaatacaaaaaaaaaaaaaaatagccgggctggggggcacgtgcctgtagtcccagctactagggaggctgagacaggggaatctcttgaactctggaggcagaggttgcagtgagctgagattgtgccactgcactccagcctgggccatagagtgagactgtcttaaaaaaaaaaaaaaaagtaatatgtggaaaggatgtcagtcttccagttactattttactaacttaaaaataaccttccaaggaaaggtattaagaaaaattactgccagaattttcatttcgattacatggacaaaaattgtgacatcacaaaatcaatccctttttagtgattttatacagttatgaagtgtatgatcttttagataccaaaagcaggggggacagtcaccatcaatcataaacagcacaggccaggcacggtggctcacgcctataatcccagcacattgggaagccaaggtgagaggaaagcttaagcacaggagttggagaccagcctgggcaacctagggagacccggaaggaaggagggaaggaaacagtacggggagtccagagtgacgagatcctcatcaccacagctgagctgagaacgggtgatgcagggctgggtgtggtggctcacacctgtaatcccagcacttgggaggccgagatgggcaaatcacttgaggccaggagttcaaggccagcctggccaccatggtgaaaccctgtctctactaaaaatacacacacacaaaaacaacaacaacaacaacaacaaaagacaggtgatgcaggagaacaagacacaagcaaggaacagagcccatccaacactagaattcactggcgcatgtatatcgatattgatactgctgtgtattttctcttttcttaatagtttcaacatttccaatactacatttcccaggacagtctcctaattaagtctacttctttgcacctagagaccactcgtcttttatattctgataattgaccctctcctcaaatcacaaggtacacaaagaagaatgaggttatttatacatccttccatccattcattccaaccgaccatccggacaggaaagtattactgaacagcaactatagagaaggtgcatagtttcattttaataaatgttttaaaatggctaggttgactgctaggttgaagagttgcaacagcagcacctgtgtggaaattcaataccacggccaggcagtaagactttaaaaagcaaccacttgtggtcgggtgcagtggctcacacctgtaatcccagcactttgggaggccgaggcggggggatcatgaggtcaagagattgagaccatcctggccaacatggcgaaaccccatctctactaaaaaaacaaaagttagttggatgtggtggcgcacacctgcagtcctagctactctggaggctgaggcaggagaatcgcttgaacccgggagggagaggttgcagtgagccgagatcatgccactgcactccagcctggcaacggaacgagactccatctcaaaaaagaaagaaaaaaaagcaaccactcacatgaggtgggaacagaggtctccactgttaattatttggaaagatcattctccaggagagaaaaggaagcctgacaaactttttatatttgtgtcaagctcttctaatactagaaaggcaatttggggaaatctgcaaactcctgggtgggtgacctctgccccacataatacacagatatatttttcaaatggaatagggtcttaatttccaatgatgggtttttaaaatacaaaattagtacaagtactttgggtgagtaacacgtctaaagaaactatgcaatctgaaagttgcggccttaaatgtgcagtcatttagcaattgttttgctatggttgttcttatttatttgtttgctttttactataagcaagtggcttttatctctctgtccctcaatttctgtatctgtaatacagaaattataaatgtaactgaagaatcgggttgttgagattatgagttaatgcatgtaaagtgctcagaaagagcagcagctggtacgcagtgaacacttaacacatgttaactgctattatggttattattagtagtaaaatacatacaaagtcacacttaattcaggtctaccaagaatcttttagtgctttcagtatgttattttaaaaattatagtgtgatgatttggtaatcactattttcttggggattaccagattttttttttttttttttttttgagacggagtctccctctgtcgccaggctggagtgcaatggtgcagtctcagctcactgcaacctccgcctctcaggttcaactgattgtcctgcctcggcctcccgagtagctgggactacaggcatgtgccactatgcccagctaatttttgtatttttagtagagacggggtttcaccatgttggccagaatggtctcgatctcttgaccttgtgatccagccacctcggcctcccaaagtgctgagattagaggcgtgagcaactgtgcctggcctgcagattaccagattctttggctagaaatagaaatttggatatttcaatgagttcaattttcatggtgaaaactgaaacagataagaggattcaggtgactaaatataggcaaagcacacagaatccttgcaagaataacttctgatgggaaagctgtattttactctagatcaaggagaacatgaaggaagaatggaaaccgtggtgggtctgcagagaactacaaaaataggttacaatttgagccatgtagaaatcacagtcactgggattcatgcaattacgctgagagatagagatgagagtctgcatcatcgtgacagatacaagaagtgatattggggctgggctttgttatttccatgggatagtcaggtactgagtcaaaaatttgttgagataaaaaaataaaaataatgacaggggaaaaacctaatataattgacaacagcactggtctagtagagagagcacggcaatcccatgagtgttcatggaaatggccatttatttatttatttatttagagactgggtctcactccgtcgcccaggctggagtgcagtggcacgatctcggctcactgcagcctctgcctcccaggctcaagcaatcctcccgcctcagcctcacaagtagctggcactaaagatgcacaccaccacacctggttaatttttttgtatttttagtggagacggggttttgccatgttgcccaggctggtctcaaactcctgggctcaagcgatctgcctgcctcggcttcccaaaacgttgggattacaggcgtgagccgccccacctggccagaaatggccttttaaaggtagccatactgtgcctcagtttctcaactatcaaatgaaaattaaatggaggcaattttactctacaaagttagaagaccgaaggagtaaatgtgaatgttcctttttaagagagacctttgcgaaatttaacattgtatttggatactgccatgcatttagtcttccagattaactttggagtcactttgctaatttccagcaaaatccttttggattttttgtttgaaattgagttaaagtgtagattaatttggagacagtgttttaatatgaaatctttcctgctgggaacaggacatgcctctccattgactgaaggcttcgagtgcttcaggagagattcttagttttcttcctaaagttttcttacacttctcattttgtttgtatttagacttatatcctctttggttgatattttgacttctcccactctattttgtaactggtttataggaaagctattttttaatatcggtcttataaccagctactttatgaattctcttattctttccatcagtgtttcgttgattctcttggggtttctgactacacagacatagcaactgcaaaaaaaagggaatcatttaatctcattttcccaataggctcatttcttcatcatctttttacatgggctaaaactaccagaacaacattgaataatggtggcgatgaggggacacactttgtgcttttgtttcagatttgtaaatgaatgtctatgggattttatccctaagtataatgttagttgctgatttcagttagaaaaatgctatcacatgaaagaagattccttctacattttctttactagtggtttttcttttttctttttttttcctttttggagatggggtctccctatgttgaccaggctggtcttgaactcctggcctcaagcaaccctcccatcttggcctcccaaagtgctgggattacaggcaccagccaccgtgcccagcctcattagtggtttttcaatttattactttactgtattaaggttcctgcttactcaaagtactttccataaagccccacaggactcatttttgtcaaaaacctatgcacccattccaatttaatatataattatgagattatcagttagtactgtcataatttgcataatcattaggacctgaaaatatgaagcccctctttaattaatatgatgaaaattaaattcaggaaataagcgtgatacataagcgcctcgtgtaaggcattttatgagacgctcctgaacagtgttgctcactgaggggcctgcagctcacttgaagtgtctctgtgagaatacagattgatgggctgcactccggaattcctgagacggaacttgcagaatagaggccggtggccgggcgccgtggctcacgcctgtaatcccagcacttccggaggccaaggcaggtggagcacttgatgtcaggagttcaagaccagttcgagagatggtgaaaccccaactctactaaaaatacaaaaattagctgggcgtggtggcgcatgcctatagtcccagcttcttgagaggctgaggtgagaggatcatttgaatccaggagatggaagttgcagtgagccaaagatcacaccattgcactctagcctgggcaacagagccagactctgtctcaaaaaaaaaaagcgtgaacccgggaggcggagcttgcagtgagccgagatcccgccactgcactccagcctgggcgacagagcgagactccgtctcaaaaaaaaaaaaaaaaaaaaaaaaaaaaaaaaaaaaaaaaaaaagaatagaggctgggaagctgtattttcaaggagattcccaggtgattcttacacatcttatagtttaaaactctgccacagagaatgaaagatcaagtaaaacatacagaacttaaaaaaaaagagagagagacagaggcctggtgcggtggctcatgcctgtaatcccagcactttggggggccaaggtgggcagatcacctgaggtcaggagttcgagaccagcctggccaacatggtgaaaccctgcctctactagaaatacaaaaattagctgggcatggtggcaaatcacttgaacccaggaggcagaggctgcagtgagcagagatcgcaacactgcacttcagcctgggcgacagagcaagtctcaaaaaaaattttttttaaagagagagaagagtatatttgaacttaccatcagagaggcaaagctaaattcatcatgagatagtgattaaactggttgtgaacataataaaacagctcagccacgctcatgcaccactgtttgtctaggcttagttctgactgcttctaggaattcccttcaatcactgggttttccagctgagccatacagcctccaatgaaggaaaagaaaggaggccaagtcactgggactcttttttttcaactttaaccagagcagctccacttacatctgttacggtgttttagggttctgagcaatatttttaagaataaaagtttgaaaattatcgactgacactctttaaattgtttagattagatttcgtaagattgcacccctgtcttactatcaagtttgatcctttatgttggtacacatgattaaaactcaagaagttcatggccgggtgcggtgactcacacctgtaatcccagaactttgggaggccgaagtgggtagatcactcaaggccaggagttcaagaccagcctgaccaatagcctttagtagagaccaaccctgtctccactaaaaaattcaaaaattagctgggcgtggtggtgcgcacctgtagtcccaggtactcgggaggctgaggcacgagaatcgcttgaacctgggaagcagaggttgcagtgagccatgggcgagccactgcactccagcctgggcaacagagtgagactccatctcaaaagcaaaacaaaacaaaacctcaaaaaaaattgatttgagcaaatttgacaaaatctgttttacatttttcttttcttatacatctctctcaaaagatgaaatatcttctatatcataattttgcatataatatgtaatgcttctgtgaatttgagggcattctatgactattattattattattatttggaaattctctaatactgtgttttaaaagttttggaaagggagaaaaactccagatgaaatactgaaggggtaattgatgtagttctgtcccagtgaagggagcttatgttccccccttcactgggacagaacctgcatcaatgactagggcagcagctggagcttctgacgctcacgctccggtcacctgtttgttttggtgctcgtcctctcaccacgctgggctccagttccttcttggataaactgaaccagttggagcatgagatttccaagattcttcccagctctacaagttgataacttctttgtacgtcaaagaatcccacatagacttagattacggcaggctctctctcataaccaagaaaaaattctggccaattttcagacatggaataatgctccgtatcagtatacattaagattaatttattctaagattaattaattcagcataataagtatctgcttatgtgtaattaaaaggaaattattttaagggaacctgagctaatcatcgtgtttgttttttgaatatcagcatgataaattaacttattgtgttccattaagataaccagttcattgcgggcaaggatggcatatgaaatcaagcccagtatctcatttctccactttaggttttagtttctccttatatttattttttaagacaagtttttattttacaggtaggatttcctctcctcccacagtctctgcagagctgaaattttcaaagctttcttttttctttttagttgtgctccatgatttctcaccagtgcccacttcttataacaaaaaaaatgaactaagttgaaataggagcctcttgtctatttagcaaatactctctgtgcacagcctatagtcctagcagtgttagaacactggaagggaatggggtggccatgaccttgagaagctcaggccttctcaatgccctggaaaaagtggaagccatattcagtatattgatgtcatgataaggatgatacttaacaaataatactttttatcttttcaacaaaaaatccttagcaacaattgcttatgaaatacacatttgaaactttaacaatcacggtattggtttgaagcagagccttagtaatgtcccttagtggttgtcgaaaccaactgaaaaacaagataattagtgaattgaagtaattaataatattttgtgataagcaccactaacaaagaagtaaagacaagtacatgaaatgacagctgccgtacataagaatcacatttcccttcccctcctaaagaatcctagtaggatatcttataaaaagagagcttctggggtaaggtgacttagagggagaaaaaaacatgcagatataacctacaaaaggcatcccagtctattctttgcttagagactgcagcatagacactgttcccatgaggcagggtcccacagggttaaaaacctatctaaaacaattctgcagaggcagcctctgacattgcgttgaaagggtccacgcactctgtgagctcatatttatgacatacatagggttctctttgctgggcagttctttcccttgtgttgaagagacacgtgatagttgaccctcacctcacggctccctcacttgtgaattaaagtcagacactgccgtaaggttcttctggttcctgctttgtggagaaagctttcagcagcaatatctgggatcactggtgtattaaatgtcaggcctcgcatcattattctgccctgagctgatggtaaaccgggcacccagccttttagctttcatccagcacgagggaacttgccttcagatgtgacacgtacaagtcaaaaaagctcagagtcagctccaacgtctattggatcccactctatcgcctttaaaaaggaaaagaaaatcgaattcacagaaccgaggctaaatacgaccgttaagaacggactgcattcaccatatttccatgagagtggcaaagagaacaaagataaatgccaggctacatcttggatcctttgccagcttgtggaagaacttagcagaaaaagatgtgaactctactgtttaggaataaaataacttttaaaaataaattattgaaaagtgttatttggctgtttcttttatgcattcaaaagcaaaatagtaagaatccagtggactttgaaatcttcctatatgttaaaaaataggccgggcgcggtggctcacgctgtaatcccagcactttgggaggccgaggcgggcggatcacgaggtcaggagatcgagaccatcctggctaacacggtgaaaccccgtctctactaaaaatacaaaaaattagcagggcgtggtggtgggtgcctgcagtcccagctactcgggaggctgaggcaggagaatggcgtgaacccgggaggcggagcttgcagtgagccgagattgcgcccctgcactccagcctgggcgacagagcgagaccctgtctcaaaaaaaaaaaaaaaaaaaaaaaaaaaaaaaaaataataataataataataataataataattagagtccacctaaggtaagaatctaggactcatttttgtattgaaatttcattccttgtaattcatattttttcatgtgatccctgaaataaattaaaaaagaaaaaaaaaggtaccagtgctcgtaagtagaaagtggagaactaaacgactccaaaatgtgcaatatgttgggcactggtggccagctggtaaaaatcttatgagagttgcgggttttcgaaatatatgtaatttagttatctgtcaaaatgagatccgcatctacatggctttacccaggaatgcagaatttgagactggagcgtagggagggagaagcctatgggtcttgggttttccggaattggattataaatacgaacaggtttaaagaaataatgaggccggcagcgtgtgcgaggagccccgcgcttcctgggcaccacgcggcgggacccggggaggcaggcggggacccggggaggcaggcggggacccggggaggcaggcggggacccgggcaggcaggcggggacccggggaggcaggcggggacccgggcaggcaggcggggacccggggaggcaggcggggacaggcaccagcccacttgacaactgcgcgcaccggcgcagccggcagctcgggggcgcgcacacccacaccgcgccacgtgcgcgcgggggctgcggagactacccgagccgcgtgggcgcgtcagagccacctccgctctctctcacgtcgccagggattcttgacggatgattccgctgtcagatgccagcttgcctctgtcacaccgttttcctgaacgcagtagccatgtatttgaaagccgtgtcatgtgtgaaacgagtttaccttgtagattaggataaacaaagattctccgtgctcatccaaaagtccaaagccccctccgctctgcaatttccacttgttatatgcagaactattctcacctcgggaatgtgatggttttataactgtgggggcccaaatgtactgactaggactgttttcccgcactcaccatgaggaggtgttcagttggacatgtgcctaaggatttttgttggctttttatttagtatttgctcattttggaaaaaaaagtacaaactaccttcgagctgggagctacacagagaggcttgctcagattcagatttgttttggtatgtctgtttcataggctgcagacttcctactgtgtcacatccagtgcgcatcatacctgctggggtgtctctcagggatgttaagattgatcagtgggctcggatcctgtcaacccgatatgtccattataaagttctccttcagctcttcacctgtggtttcagcagccattgataatcattgcttagatacttcatttcattagaggttgcaaaatggcaatattttaatttatcatttctttcatgtatcagcaggatcttttcccatcaattatttggctaccctaaatacagttcatacaggaagggcaaaataaatacttgatccttactctttatttttggaataaagagttgtttccttagcactctccaaaggtgaccaatccatctatttttggagcattactctcaaccggtggatgttaccatacttgatgtgtcttaatatgctacagtatttatttacttatttatttgatggcccaaataccccactttcagccagggctcctgtagccttctgacacaaccatagaagtctttgacgtattatgaaagactatgtaatattccaggggtcagaggaagatattaaatgacatcatggggaagcaaaatcagcaaaatttagaaagtgagaaactctacagcacgcatcattcagtttcttcaacaatagattgcaagggggtagagaaggagggcgtgaaactcctctagggtcagaagagaccaagaaacttcagacaaaagcaacatccggactttgtttggatactggtatttttttgtttttttttttagattgtaaaaaaaagagttaaggagatggatgatggtaatggttgcacattatgaatggatttaataccactgtttacttaaaaatgaataagatggtaaattttatgttatgtgtattttaccatgataaaaataataaattaaaaaataataatttggctgggcacagtgattcatgcctgtaatcccagcatttggggaggctggggcagaaggattgcttgagggccaggagttcaggaccagcctgggtaacatagtgagaccctgtctctacaaataattaaaaaattagccaggcgtggtggcacatgcctgtggtaccacctttttgggaggctgagatggggggattgcttgagcctgggcgattgaggctgcagtgagccaggatcacaccactgcactctgaatgacagagcaagaccctatctcaaaaaaaaaaaaaaaagcaaaagtaaaataaaataatttatgagaaaatcaaggaaatttgaatgctggctggctttttgatgatatgcaggaattactataaaaatgcgtaggagtggcaatatgattgtggttatgttaaaaaatattctttcgattttaaagacgcatagtgaaatagtatagatgaaattgtatctcgaatttgtttcaaaataacctagtggcagtaaggagagaaagtaattgtggtatgatggataatcattgaagctgggagatgggtacctgggggttcactgtgttcatctgtctggttttatatatgtttggaaattgcataataaaaagtctaaaatttattttaaagtacagattaccctagaaggaagccgaagaggaactgatagtggtagaactacacaaactccataaataaagtcttgcctaattcagacatgtgctaccacctgccagctgcagtggtggagtaagaggaaaagcccagtgactaagcaaggagagtaactgtcttatattatcgagggatgctccgggcctgtgctaggtgctttgtatgcttttaactcatttaatccttacaatagtcttatgagatagatactattatgttagtataatatccacactacaaatggaaaaactgaagttcagagaagccactctcttcataaacagcaaagataggcttcaatccatgtggtctggctttggagccagtctactgataagagcaacataagtagctcttaatagatgccagccctgttttaagtgttttgtgtctattaattcatttaatactcacaataaccctatgaggaagatactctcataggacccattttacagatgagaaagttgagatacaggcaggtgaagtgactgtgtaagatcacacagctggcacacggcagagccagatgttaagctgggagtttgggctccaccccaccctgctgcccctcacattattaaccactgggctacagtgacagctagctatgcaggctctttccttccttaataaacatttattgagcacctgcaagaggcagtctctgttagaggcgctgggatatggtgatgaacaagacacattttgctttaccttccggtgacatacagtctcccagtccctgaatctcttaggagctaatttaggagatgaaggggttaaactcagaagctcaggctaccgtgttggcactttcttgttttaagctgaattggccagagggtgatgcatgcctgtaatcccagctactcaggagggaggatcacgcaggagttccaggccagcctgggcaacagggcgagactctgtctcaaaaaaaaaaaaaaaaaaaaaaagttgaattggaaagagcattggatcagcagcccaagaagggcgcttctgaacttgaaaatgtcagaggtaaggctgtgaaggaagttgcctgtggatcctactgctctacccactgggtccagtaggtccctttccgctagacaccattctcatttctttcctagaatcctctctctcttctgctgggttctgttcaaccccaacttcttctctgcttcggagctcaatgagctcctcttctctgaaatctcaatgcccttgttggttgcactaatcaattcaatacttaattatatacaaagcttgattgttatccaataattttactacgtatgtcttgcctcctcacttaaactgtacatatttacaagacagagactaggtcttatacttcattgatattctcccagcaagccccaagccatggagtaggtgctcactacatattatttaaatgaataagtcatattttcaataatattgtgtatgttagatgacaatacatagaatgatcaagagcacagactctctctcttcatagttgtgtgccaccaggcaagttattaacatcctttatgccttagttttcttatctgtaaaggagggataatagtttctaatccacgcacatggaattcttagcctggcgcccaacgaatgttcaatatatgctatcagtcaatatttttattattactacaactgcctagtaaagtaagattagattgactaaccagagcatttctcctacatgtgacgtcaaattaaatcagaagtttgcttgatgagcatgatttggtgagcatgatttggtgagcatgatttggtgagcatgatttggttggctgtggaggccgtggactgtagcggagcaagaatgggcattaaaatctcacctctgactctggctgtgagaccttggctttcgtgagcttcagtttgttcatttgcaaactgcaaatagtaacagatatatcccattgagctatcgtgcgggccagatttaatgaatgtaaagcacctagcctgacacaaaatggaactttgataaaccattctctaaatatcatcaagcccatagcgtccctccctacagagaccgtgtctgcttagtagatgagacatttgtggttgttcattgactcctttttttctagaaagttctagtcctctagagactcattgtaatacctttgtccctctgaattcttggtatttaactatacctcctcctgttatatgcacccagggtaatatgcctctggcacatggtaggcacttaatgaatttatgtggaataattcagcaacttacttttatagatacatacagactatccctcttctatgaactcattctttctcagtgtatcaaactaccaatctgctgagctcattcacaacattttggtgcttcttaatgttctcagagaataactttcactctagtgctggcttcttccatccactggtaggggtttggatcagataaaagggagaacatcccaggctgggtgcataatgtttggaaagggttaaggaaggccaagtgaatagttcttgactgaaactaagagtacgagatgggagaaaaaatcagagataagattatatagggagggtggagacagattgtagagaaactttaaggtcaggctgaagaatttgacttgatacatcaggcagctggaaaagtcaggggatagtttacacaagttatagtaatttttaaatttaatttgtgtacatgaggttaaagaattgaagttaggacatgggagtcattacatttataatgaaaaaacgcatttcctgtcccaccttcccaacccactgcccagaggcaaccatgatcaactcaacctattgattatttgaatgtaattgtttatttctttctttctttctttcttttttttttgagatgaagtcttgctctgtcgcccaggttggagtggcagtggtgcaatctcagctcactggaacctccgcctcccgggggtccagcgattctcctgcctcaggctcccgggtagctggaattacaggcacatgccaccatgcctggctaattgttttttgtatttttagtacagacagagtttcaccatgttgaccaggctggtctcaaactcctgacctcaggtaatccgcccgcctcggcctcccggagtactaggattacaggtgtgaaccacatgcctggccgaatgtatttgtttctttttgagaagggtaattcccaactcttgctccattaccttcccatcatttttccagtgtagtcatatccttgtttttgttaaataaatagcatttccatctttatatagttcacagctaattacatttttcttgtacactctttttggttctcctaatgtttgttaacttttactttttaatgatttttaatttaaagttttaaatgtgtttttcctggttaataattgtcttgctttaaatcatttaaaaatttttttcagagacaaggtcttgctttgttgcccaggctggagcgcagtggtaccgtcatagctccctggagcctcaaactcctgggctcaagggactctcctgcctcagcctccaaagcagctagaactatagatatgcaccaccacacccagccagtttttctgtttttttggagatgaggtctcgctacgttgccaaggctagtctcaaactcccagcctcacttttttatttacttcattttttgtgtacttactactaaatcaaccctaaatgttccaataaagatgtaaactgatcaaatacatgaaataacccattagttttattcttttcttgaatactttcttaccagaaccttctctgcctattttaaccaggactgactgctctctgagctcaccacacacctgggatttttcttcaccaacaacttggaaattttcttgaactccttgctgtgtgggatttcctgtttcttggatctcatgtactcatctttcttgatttgccatgtgtgcgttgtggtggggaggggtgtacatctgcccgtaacttgctgagaaaaagcatgggacaaataaaatttttgctgtgcaagagcacggtagaaaatgtttttattttactttcttctacaggctgggattatgattttagtttgaaaagcacatttcctctgaattttgaaggcatctctcaatttcttctgttgagaaaacgaatgctgattttatgttgacatagagcaatatggcgttattccaattcctgatcttttatgtgtgacctgttttatctttctagaaagttttagaatcttctctgtaaaatgaggataatatgagtacctacctcactggattagtaccttaattgtgaggattaaaccaattaatatatcaaaagcctttagaatggtctctgacccatggttaattttaaatgtgcttgttatcagcacatttaaattaatccatggttaattttaaatgtgctcattttagtagaattttgggagaggtgatataaagacttatgttcaacttgtcatatgtaacagggattgcagaagttaacatttttaagttttcctcatagcatttttgtggaggttattttcttccaagactgaaaaaataaccaaaagatgaaatgacttaaggaactattattcagggatattgatcagggcagtgacccagctaattataataagttggtaaacacgttaggatatatagaaagaaagcaggatgttactgtctgctgaggcttaatgctaacattaaatcatgttccccaaatatagtgggttcatttctacagtatacctgttcataatgattcatctctgtgtcctcagcacgtaggccactatttgattcctggtaggcagtagatacaaagcacttggcaatgtctctgacaggaagtaagcagtacctattagctctttatatatgtaacacacatcatctacttagaaactttgttttagttctctttcaagtgacctttctcgtgaccttagagaaagaatttgtatgcaattgctaatttccccatatatattcgcattcattattttcatttgatcctcaaagtgtccaaagaattaaactgagttttgaagatggctctagtgcttactagctgtgaacaagttacctaatttcttcttatttttctcaagacattggggatcacctcatgtgaggattaaattagatcatctatgtcaagcactcaatgcatatattagctattgctagtgaggtaaagtattattattattattattatttagacagagtctcactctgtctcccaggctggagtgcagtggtgtgatcttggctcactgcaacctccgcctccaggttcaagtgattctcctgtctcagcctgtggagtagctgggattacgggcatgcaccaccacacccagctaccttttgtatttttagttgagacagggtttcgccatgttggccaggctggtctcaaactcctggcctcaagtgacacccccgccttggcctcccaaagtgctgggattacagatgtgagccaccacacccagcctagctaaagcattattattttacttatttattttgagacggagtctcgctctgtcacccaggctggagtgcagtggtgtgatcttggttcactacagcctccacctcctgggttcaagcaattctctgcctcagcctctcaagtagctgggactacaggggcctgccaccacacccagctaatttttttgtatttttagtggagacagggtttcaccatcttggccaggctggtcttgagctcctgacctcaggtgatccacccgccttggcctcccaaagtgctgggattacaggcgtgagccaccgcacccagccaagctaaagcattattaaccctccttggtgattagactcatcagaacacagaaattaaatgacttgttcacatagttgtgcgagtggctgatcttggcttaaagattggcactgaatgattcacagtgcaaatgttagaggagtttaatttatgttcttgctcactgccgtatcccagcacctaaaatagtatctggtaaataacaggcactcatatatgtgattaataaattaacatgtacaaaaagttttaatcctggaaatggcttcatagatcatttaatgaaatgaaccagtttttcaaattggtaaactgaggcccagatgctttgcttttaggtgcaccgtaggcacgttttgtgtttgtttgttttgtttctttgcatcttcacagtgcttttttttgagacggatctcccactgccgctgaggctggagtgtagtggtacaatctctgctcactgcaacctccacttcccgggttcaagcaattgcctaggattacaggcacctgccaccacgctcagctaattttttgcatttttagtagagacagggtttcactatgttggccagggtggtctcaaactcctgaccttgtgatctgcctgcctcggcctcccaaagtgctgggattacaagtgtcagccaccgcacctggcccacagtgctttttaaaccactgaagtaattgtcaaattaggtttggccacatatgaatagaaaagccaaattagtggcttatataagatggaggtttattcctctcccatgtaaaagacaaaccaaagataggcaattcaagatggtggctccagagtcagccagaacctaggcagccatctttctgctccaccattcttgccatatggctttcactctcagtactgtcttatgatacaaggaggctgccagggttccagccatctgcattcattctatcaggaaggagaaagacggagagagcaaaaggggacatttcccagctgaggtggctgcctttaatttccccatttatcttattatccacccatggtgcaagagagactgggaaatgtattattttatccaggaagcttgctgcccagattcaaagcagtgttctaaggaaaagggggaatggctattgggtaggccgtctctgtcagagttgtcaacattttgcaaatcagaaatttccaaatagaaatctggattttttttagcttttcttgaagaatcagaagatggagctgaggtttggggccagagagaaggaaacaaggagctggattttgaagggagggctggatgaaatggagaaggcccatgaaacagactggcgagggagaagggagctgatgttctaggacttgagaagtgatttaggaatttgcatccctcgtttggtagaagtagtgctttgaaggctgagtacaggggcttacaactgtaattccagcacgttgggaagccaaggtgggaggattgctcgagcctaggagttcgagaccagcctgagcaccacagcaagatcccatccctacaaaaaatttaaaaagattagtggggtgtggtggtgcatacctgtggtcccagctactcaggaggctgaggtgagaggatcgcttgagcccaggaggtggaggttgcagtgagccatgattgtaccactgcactccagcctggacaacaaagtgagaccccatcccaaaaaactaaaatagtgttttgagaggattaaactagtagagagtatgtataacaagagaaggcacaaagaatagttagggaactattaaagagctccaagcatgagtgaggagggtccagaccagcaatgtcaatagaaatatagtatgagccatgtatgtcattcaaaaaattttagtagccacattttaaaaaggaaaacagatgaaattaattttaataatatattttatttacccaatatagctgaaatatcatttcaacatgtaatcaatataaaaagtcatcaatgagatgtgttacattctttgtttttttttgttttagtttttgttttgagacaggttctcactctgtcacccaggctggagtgcagtggcacaatctcggctcactgcaaccttcacctcctgggctcaagggaccctcccacctcagctgcctgagtagctgggattacacaggcatgcatcaccatgcccagctaaattttttttgatatttttagtagagatggggtttcaacatgttggccaggctggtctcgaactcctgacctttagtgatcctcccacctcggcctcccaaagtgctgggattataggcatgagccactgcgcctggcctgatctgtatttagagtgcataaaatttatagttgaaaaagtagattcacataaccaagttattcttcacaaactaaaaaattttccaacaactaaatcaagtgtatgcatttttacatttaagttaaaatgaaattaaaaattcagttcttcagtcatactgaccatgtttcaagcactcaatagccacatgtggccagtgacttccatattggatagcacgttccagacagggaaagaagacagaaataaagggcccagtctgagatgtggctcataaaggatgctcctcagatggaacacttctgacgaaacctgtattatcattgtcttccaaaagcatggaaattctcgcatttcccacatcccttagatttgccagatccttttacacgcctgtgcctttgcctgaaatgcttttccccttctttttgcacctggaaaatgtcaacttacctttccagtctccatttaaatatcatctctgtgaaatccaccccaggtccatcaggacaggctagttgcccctaacactgtgttcctatttcatgtctcatagatccgtcatgtccttgaggtcgaggactatgtcttgattgtctctgagtccttggtacatggcatgcagacttataagaatcgttattgaatgaagaagaccttccgtttaaccacacctggctaatttttgtattttcagtagagatggggtttcaccatgttggccaggctggtctcaaactcctaacctcaagtgatgcacctgcctcagcctcccaaaatactgggattacaggcttgtgccattgcgcccagcctcaacacgcttaattgaagatgtcattgattgtaaggtgaaccattgttttgtgcatcattaaggaaaaaacctgtcagtaataattgtgagacccagcacaatggctcacgcctgtaatcccagcactgtgagtggctgagacaggcagaacgcttgagcccaagagtttgagaccagcctgggcaacatggcgaaacctcatctctactaaaaatacaaaaaaagccaaaaaatacaaaagccagctgatagcttcgctatcagcactttagtcagctacattttaaaaggatatgcttggcctccttaattcaatttttgctttattaacttgaatatcattggacatggccctctaaatagcagacttcgaggctggcttctaactttaagctccatacataaaatttccgtggtgcagccttatgtaaaacattcatcttctttaggttcgatatcagtgcatactgctgccctgcgtcacacatttgaaattaatgtgtgtgtctttttgactgttgtcttttatgaggatagacaccagcatacagcagtacttgaatgacaaccacaaggatttttcaaaatataggaggtattcattccagggtagcttacctgagcgaggtgctgcaaaacagactgacagcccgaacagacgcaccttcactcctcaggtaacaaggaacacattccactagatattcttaacttgggcacaatcaacttcagggggatggggcaactgatctccagtgtagctgaatccaccttggttacatgctctagatgggaagaaaggaaaggaggcttagatgatctcaagtggtagaaaggtatttggcaacatcaattaaaaggttaagtgcagattccctttggccctccaaattccacttttaggaagctactgtgtggaatatttgcataaagacataaatttatgaagaaaagaatgatccttgtttttttttgtttttgagacggagtctcgctcttgtcgcccccgctgtagtgcaatgggaagaccttggctcactgcaacctctgcctcccaggttcaagcgattctcctgtcttggcctcctgagtagctgggaattacaggcatgcagctccatgcccagctaatttttgtatttttagtagagacggggtttcaccattttggacaggctgatctcgaactcctgacttcatgatccacccacctcggcctcccaaagtgctgggattacaggcgtgagccactgcacccagcctatttcaagttttcaaaataacaaccaagaatacaaaggtcagccgggcccggtggctcacgcctgtaatcccagcactttgggaggccgaggtgggtggatcacgaggtcaggagttcaagatcagcctggccaaaatggtcaggccaacattccaaccaatgttttgtaaaagcaatggcaggtaagtggcctcctctctagagctgaagctttttgcgcttgctttggtgtcatgcccacgcagctaactcgtttcctcagattctattccattccatttctttcttttcttttctttctctttctctttctttcttccttccttcctttcttcttctttttttttctttttttttttgagacagaatttctctcttgttacccaggctggagtgcaatggtgtcatctctgcttactgcaatctccacctcccgggttcaagcaattctcctgcctcagcatccagagtagctgggactacaggcatgtgccaccacgcccatctaattttgtatttttagtagagacggggtttcaccatgttggtcaggctggtctcgaactcctgacctcaaatgatctgcctgccccagcctcccaaactgttgggattgccggtgtgagacatcgctcccggccctcagattccatttctatgctttctctctggttcacattcaaaagtcctgaagataaaggatctgattaggtcagttcatcaccattcaatatggattactcctgctgtgtggggagatgcgtgtaccaggccacctcatggacggaggtctgcttttatagcccactggctttggtggagctgtttcagagtacagtctggtgtggccaaggttacagcattatatgatgcaaagtaaggtgacaggcgcgaagcatgctcatgtcttagaaggaaaatatgggcaaggcatatacgtagcactccatggaccatccactctcctcggtttcatttatttatttatttatttttcactttgggatggagtgtcactctgtcgccaaggctggagtgcagtggtgcaatcttggctcactgcaacctccgcttcctgcgttccagcgattctcctggctcagtctccttagtagctgggattacaggcacttaccaccactaatttttatacttttagtagagacggggtttcaccatgttggccaggctggtctcgaactgcagacctcaagggatccacctgccccggcctcccaaactgctgggattagaggcacaagccactgtgcctggcctctctttggttttatacacctaaagagaaagagggaaagcaggataaacattcacctgcagtcactaagaaatccagacaagaacttcctttaaagatgtccttgtcagtggagaggaagttcatcttcacattttccaggtggatcagttggtgttccccagaccaccaggtttgcacttgtgcatgctcgaggacaacagagaaggttctagaagcagcttttctgcactacttggagctttcttttcgtttaaagatgaattgtttggttggatgcagtgctcatgcttgtaatcccagcactttactcctaaagtgggagtaagtgggaggatctcttgagcccaggagttcaagaccagcatgggcaacataggaaaaccctgtctctacaaaaacataaaaatagaaataaaatgattaattgaggtcaggcatggtggctgatgcctgtaatcccagcactttgggaggccgaggtgggcagatcacttgaggtcaggagtttgagatcagcctggccaacatggtgaaaccctgtgtctactaaaagtacaaaaattagctgggtgttgtggtgcatgcctgtaacctcagctacttgggaagctgaggcaggagaattgcttgaacctgggaggcagaggttgcagtgagccgagatcacgccactacagtccagcctgggtgacagagtgagattctgtctcaaaaaaaaaaaaaaaaaaagattagttgctggatgaaaggtaagcaaaaacaagcaaaacaaaataaaaaacagtggtattgcttttgcttttaagacgatgacaaaggtcatcgtatttacaggaatgaaactgtggcgagctgggtgcagtggctcactcctgtaatcccagcactttgggaggctgaggcagacggatcacctgaggtcaggagttcaagaccagctgtgccaacatggtgaaacttcgtctctactaaaaacacaaaaattagctgggtgtggtggcaggtgcctgtaatcccagctactcgggaggctgaggcaggagaatcgctggaacccggaagctggaggttgcagtgaaccgagatcacaccactgcgctccagcctgggcgacagagcgagactccatctcaaaaaaaaaaaaaaaaaaaaagaaaagaaaagaaaagaaaagaaaaaagaaaatgcggccaaaatttttatagaatctgggattcctgtgatgctgtgttcttgaactgtttcagagcctagtctgggcacctatttttaaactttaaaaggcaggtcatcgaagcccttcagaaggagggaaaggaagccagagaataggtgtatccaaaagtgctgtaggaggaacaggcctttcgctatgtttaattcaaaagcagatatcttcaagcctctaggaatatcgtctattgtcattgctggcaaaatgtccatctgtctctgaaaacctccataagatgtatgtgtatttgcaacaattccaagcaaggtaaggcccttatttcctgtggaaagtagtaccaatatggaaggcagcctgtgacatggtttctttttctttccttcttttttttgagtcagagtctcaccctgtcaccaggctggagtgcagtggcatggtctcggctcactgcaacctctgcctcccgggttcaagcgattctcctgcctcagcctcctgagtagctgggactacaaacgcacgccaccacacctggctaatttttttttttctttttgtttttgagatggaatctggctctgtcgcccaggctggagtgcagtggcgcaatcttggctcactgcaagcttcgcctccagggttcaagtgattctcctgtcttagcctcctgaatagctgggattacaggcacctgccatcgcgcctggctaatttttgtacttttagtagaaacgggggtttcaccatcttggccaggttggtcttgaactcctgacctcatgatccacccgcctcggccgcccaaagtgctgggattacaggcatgagccaccgcgcctggacgacatcgtttatttttctatgcctcaaagcaagctgaccaatttgccaatgtatgttgcttaagttgttgggtcactgaagtgttcttactatacaaagtcagtcccagatctttcaatttcggtgtacccctcacagtgtctaatatgatgctatgtactaggatttcaatttacatgaaacaaattgggattgaatatctatcttgtgccaagcacagtggtaagcactgaaatagcaaagtaagttagatatattccctaacctaaagttactcatatctaccagagaaagcagccccaataacaaccaactatgatgtagtacaaggtgtgcttgttagagatattcacagcctgccaccttcacccagttaagggagggatgaccttgtttcacctattctaagatgtacattattgtctctgaagtccagatgcatcttacaatagatggtgtctcacaattattattattattattattaattttgagacagggtctcactgtcacccaggctggagtgcagtggcacgatttcggcccactgcaacctctgcctccaggactcaggcaatcctctcacctcagcctcccaagtagctgggactacaggtgcatgccaccatgctcagctgatttttttgtatttttagtagagatgaggtttcgccatgttgcccaggctggtctcaaactcttgggctcaagcgttctgcctgtctcagccactcacagtgctgggattacaggcgtgagccattgtgccgggtctcacaattattattgacaggttttttccttaatgatgcacaaaacaatggttcaccccacaatcaatgacatcttcaattaagcatgttgaggctgggcgcaatggcacacgcctgtaatcccagcattttgggaggctgaggcaggtgcatcacttgaggttaggagtttgagaccagcatggccaacatggtgaaaccccatctctactgaaaatacaaaaattagccaggtgtggtggtgcacactttggcctcccgaagtgctgggatcacaggcatgagccaccatgcccagcccacttttctagctttctggctagtgatacgcctgctctgcctcaaccctccttcccccaaaaatctttagcaaaaaggaattcctgaatgctttaaaatcttgtagattttctcatactgccctcttaacctgaaaaggctttttccttgcataatataataactaacacttgtgcaatgcattgcaactcacaaagggaggctttcttataaacgctcattttagaggcttcatgtcagcagttaagagctgtagccacacccctgggttttaatttaccacttacttgctatgtaaccaagggcaattaattcaacttctacaggttcctcacctttaaaatggggataataatagtatcttatttcccaagcttgttgtgaagtttaaatgagttaatacattgccagacgtgcagtttacatgaaataagtgttcattgttatttgtctttgcagcacgctcactgttaagcagcaaacagtccaaagtctctgaatttagggtttaggttctgggcttataagagatggattccaccatagcacattgcttttctatccagcaagaatcctactcattcttcagagacccaagctcaagaatcactttctctatgagtctctcttcacctgtgtgtgaccctgctacaaaatcaacaatcaacaatcaacaacatgttttttttttttttttgagacagtcctactctgtctcccaggctgaagtgcattggtgtgatctcggctcactgcaacctccgcctcccaggctcaagcaattctcctgcctcagcctcctgtgtagctgtgattacaggggacagaggttgtggtcagctgaaattatgccactgcactccggcctgggtaacagagtgagactctgtctcaaaaaaaaaaaaaaaaagaacttaagatagaaccaccattcaacccagcaatcccattactgggtatatatccaaaagaaaataaattgtcctaccataaagacacctgcactcacatgttaattgcagaacttttcccaatagcaaagacacaaaatcaacctgatgggcatcagaggcagattggttaaagaaaatgtggtatatatacaccatggactactacgcagccataaaaaaagaacgaaatcatgtcttttgcagcaacatagatgcagctggaggccattagttcctaggcaaattaatgcaggaatagaaatccaaaaaccacatgttctcacttataagtgggagctaaatgttgggtacatatggacataaagatggcaacactagacactgaggaccactagaattgggagggatggagggattggagggattgggagggatggagggattgggagggatggagggattgggagggatggagggattgggagggatggagggattgtgagggatggagggattgggagggatggagggattgggagggatggagggattgtgggggatggagggattgtgggggatggagggatggagggattggggcaagggttagaaaaccacctatagggaactatgctcagtacccaagtgacaagatcagtcataccccaaacctcagcatcacacaatatgcccaggtaaaaaacttacacatgtacccctgaagctaaaataaatgttgaaattataatcaaatcaaataaaatgtctttcaaatataaatcccctattcttcatccttaccactgcagccctccactgcctggcctgcactaaagagccagcttcccactggtcaccctacctttcgtcctgcccacttgaatccagcttctccactgcctcctatcatctttctgaatcacaggtgtgattgagtcactccccagttctagaatctatagatgttgtctataatctatagataacatttgaaattcaatatgagatatacagcattttgcaatctggcattaaccgaattttctagctttctttttttctattttctttctttttttttttgatatggagtctcactctgtcacccaggctggcgtgcagtggtgcaatctcagctcactgcaacctccgcctcccaggttcaaacgattctcctgcctcagcctcccgagtagctgggattacaggcatgcgccaccacacccagctaatttttgtattttcagtagagaggggtttcaccatgttggccaggctggtctcgaactccttacctcaggtgatcctcccacctcggcctcccacattgctgggattacaggcatgagccaccacacctggccaatcttgttaaaatctttgagctatctccaaactgctttccacagtggctgaactaatttacattcccaccaacagtgtagaagtgttcctttttctttgcagccttgccagtatctgtttgttgttgttgttgatgtttttactttttaataatagccattctgggctggcatggtggctcatgcttgtaatcccagcacttcgggaggccaaggcaggcagatcacgaggtcaagagatcgagaccatcctggccaacatggtgaaaccctatctctactaaaaatacaaaaattagctgggcatggtggcgcgcacctatagtcccagctattcaggacgctgaggcaggagaatcacttgaacagggaggcggaggtttcagtgagccaagattgcaccactgcactccagcctggtgacagagcaagactccgtctcaaaaaacaaaacaaaacaataataataatagtaatagccattctgactggtataggagggtatttcattatggttttgatttgcatttccctgatgatggtgagcattttttccatatatttgttggttgcttgtatgtgaaagacattttagatagaaatccaagccaacttagatgaaagcaaaagtacctctcctccaacagctcatgtgaggcatagaaacgtatcatcagagggcaggtcaaccacatagtactggagtccagggcagggatctgacatccatgtactgccaggtaaacttgccttgttcatcatgacattctcatagatatttttattttattttattttatttatttatttattattattattattgagactgagtcttgctatgtcgccaggctggagtgcagtggcacaatctcggctcactgcaatctccgcctcccgggttcaagcaattctcctgcctcagcctcctgagtagttgggattacaggcacgtacgtaccaccacgtccagctaatttttgtatttttagtagagatggggtttcaccatgttggccaggatggcctcgatctcctgacctcgtgatctgcccgcctcggcctcccaaagtgctgggattacaggcgtgagccactgtgcgtggccagattgttgttgtttttatcagatatgcagagcaatgatccagtcatgaccagatattgcctcctgtgttttgcatgctaactagagtggtcatgatggtcttgtgcctagtaaatgacctggaagttatagagtggaatggcctatactggtggccaagacctctttccaggggagtccgataataggttccactgatagtcaatagcaatcgagtgtccactgcgccagaacactcaggaacagtctaagagtaaggaagacagtaagctccttagtcagatgggatgtcagaatccaaatacctagaaaagtaccttaaatagcatatcaaacgattaaatgaaaaatgaataatgtggtataaagcaagcatagaaaatatagtatgcactctggttgtcttaagctggatggaagccgagtggtctttgtggaagcaccggatatcccagggaggttggtgcaggggtagatttgggctaaagcagatccctttttttttttaacttattttttattttggagataggagtcttgctgtgttgcccaggctggtctcgaactcctggcctctgcctgagcctcccaagtagctgggatcacagactcaagccaccgcacctggcctaaagcggattcctgacagtcatcttaaggtctggtccaatcctcatattccaaatacccgtggccaaaaaggtgggggtggggagaggggaagaaaatctctctagaaatgtgtgaatttgggagtacagtatttactgtcctatgacagtattcattaaattccattgtaggctgggcgcggtggctcacgcctgtaatcccaacactttgggaggccgaggcaggtggatcacctgaggtcaggagtttgagaccagcctggccaacatggcgaaacccccactctgctaaaaatacaaaaaaacgagccgggcttagtagcgggcgcctgtagtcccagccacttggcaggctgaggcagaagaatggtgtgaacccgggaggcggaggttgcaatgagtcgagattgcacgactgcactccagcctgggtgacagagtgagactccatctcaaaaaaacccaaaagtaataaataaataaataaataaataaataaataaataaataaaattccattctatcaccctggcagccacagctggcccctcattaaaactagaaagcctttcctccacctcccccttggggcagtaggatggtgccattctctaccactctgaacaggttcctgtcctggggttgcccccgtgggtcccaagggagcttctagggacgcctgctctgtgacgccctatgcaacagcagctgaagggcgccagtcaggcatggcgggagctgggcaggaaggggattgactccaggtcatctgggcaaactcccgggaaggggactgacctgtcaatcacccagagagctggggtaggcaggttcccctctccccacacatttcaagcagttctaagcacctccccaaactgccagagcagaggagagggaaagtggggttttctgggaaactcagtcggcccagacaaagtgctgcctgatagggatagaatgcaagtcacatacgtaatgaaaccaatattggcagtgacattataaaaagttaaaagaaagagatgaaaatattatcatttcaacatatagctgaccaggcgtggaggtgtacgcctgaaatcccagcactttgggagggcaagggggcagatcatttgaggccaggagttcaagaccatcctggccaacatggagagaccctgtctctacaaaaaatacaaaaataagctgggcatggtggtgtgcgcctatagttccagctacttgcgaggctgaggtgggaggaaggcttgagtcgggaaggcagaggctgcagtgagctgtgatcgtgccattgtgttccatccttggtgacagaatgagatcctgtctcaaaacacacacacacacacacacagacacacacatatgtcgccaatataaaaaattattaatgaggcattttacttatttcttttgtactaatcttcaagatccagtgtgtattctacgcttacatctcaatttcgaatagctaaatgttaagtgttcaacagccgtgtgtagacgttggacgacgcaggcctacaggcctgcgcctggtgcagccaaatgaaacaaccaaaagactttcacttctgcactggggatgtacctgcatctctctcctgtaattcccctccactcagtagtcatcaaattctaaaatctggctgggcacggtggctcacgcctgtaatcccagctactcgggaggatgaggcaggagaattgcttgaacctgggaggcggaggttttggtgagctgagatcgtgccattgcattccagcctgggcaacaagagcaaaactctgtctcaaaaaaaaaaaaaatctaaaatctttcctggccgggtacggtggctcactcctgtaatcccagcactttgggaggccgaggtgggtacatcacctgaagtcaggagtttgagaccagcctagccaacatggtgaaaccctgttggggttaaaattctaaaaatacaaaaatacaaaataaaaatacaaaaattaaggctgggtgcgttggctcacgcctgtaatcccagcactttgggaggctgaggcgggcagatcatgaggtcaggagatcgagaccatcctggctaacactgtgaaaccccatctctcctaaaaacaaatacaaaaaattagctgggcgtggtggcagacacctgtagtcccagctactagggaggctgaggcaggagaattgcttgaacccgggaggtggaggttgcagtgtgccaagatcgcgccactgcactccagcctgggagacagagtgagactcgtctcaaaaaaaaaaaaaaaattagtggtggtgggcacccttaatcccagctattcaggaggctgaggcagcagaagcacttgaattggggaggtggaggttgcagtgagctgagatcacaccactgcactccaacttgagtgacagagtcagaatttgtctcgaaaaaaaaatttcctaaactgacagataaatgtttctccattttcagatttgtgatatcagggccctccagtgcagggttcagcgcaggcccccttgctctggtctaaggatggtgttggaggtggtaacattatttcaactctggatcaagccaagctcaaatccagttcctcagaacattgccattatgcgcatcctcttttccccttgaggcagtttatgaagggttttctgccaagtgtaagtaaaagagtctcaactgatgtaggggcctaatatttcctttcaaggatctgggtaatcacagaggccccctcctccggcccccaaatttctctgctgttggtgctatgcaaacaagtttcttttgaattatgaatgatcctattcgtgtttctaattgtatatatatggggtacttgcaagtctgttcagccttttaagcaaatgtgtatgttactgacattctgatttccacggaattctccatttattccaaatggacatcaagtccataaaacaattcctctggagcatcagtaaagaacaaaatagcaggaatatgaaaatttctgaacagaaaagttgtattcctgttttttttttttttttttttttgctgttgttaatgggatgtttctatgcatgaacaatgaacagtcaggaaaagaaattaagaaaacaattccatttaggatggcaccaaaaagaataaaataggaattggccgggcgtggtggctcacacctgtaatcccagcactttgggatgccaaggcaggcagatcacctgaggtcaggagttcgagaccagtgtgaccaacatggtgaaaccccttctatataaaaattagccaggcgtggtggcacatgcctgtaatccaagctactagggaggctgaggcaggtgaattgcttgaacccaggaggcagaggttgcagtgagccgagatcgccccactgcactccagcctgggcaacaagagcaaaactccttctaaaaataaataaataaatacttaggaatttacctaaccaaggaggtgaatgacttgtacactaaaaagtataaaacactgttgaaggaaatcaaagaagacacaaataaatagaaagacattctgcgttcatgaattggaagatttaatattgttaagatgtcaatactacacaaagccatttgcagatttaatacaatccctatcaaaatatcaatggtgtttgtggcagaaatagaaaaatagatcctaaaattcatatggaatctcaagagaccccaaagagccaaaacaattttgaaaaagaacaaatttgtaagacgaaagcatcctgatttcaaaatacattacgaatctacagtaattcaaacagtgtgctattggtatagagagaaacatatggaccaatggagtagcacagagagcccagagataaattcttgcatagccaaatattcttcaacaagggggccaagaccacttgatgaggaaaggacagtttgttcaacaaatggtgctagaaaaactggatgtccacatgtaaaagaatgaagttagacccttattttataccacattacattagttaaaaattaacctcaaactctaaaataccttcaagaaaacataggataaaaacgttatggcattgaatttcccatatacaataatttctcatatacaacaccaaaagtacagttaaaaaaaatatggatgtgagggtgatctggctgtggcacctgtcaccccattgattgccagggttgatttggctgacctggctgactaggcacgtgtccccttcctccctcgcctcccgaagctgtgcgcttggtttaagaggacaaccatcccagatagaggaggactggtctccggtcaagggtataagagtagctgcactccccggctagaaccttcaaacaagctctcaaggtccatttgtaggagaatgtagggtagttaagcttccaagactccagacacatccaaatgaggtgctgcatgtggcactctgcctttcttaaaaaaggaagaaagaaagaaaaagaaagaaaaagaaagaaagaaagaaagaaagaaagaaagaaagaaagaaagaaagacaaatgagactacctcaaacttaaaaacttgtgtgcatcgaaagacacaatcaacagagtaaaaaggcaacctacaaaatggaagaaaacgtttgtaaatcatatatttggtaagaggttaacatccaaaatattcacaattatttaatatataagtaatttctacaactcaacaacaaaatatcaaataatcctatttaaaaatgggcaaaaacctaggcacagtggtgcacgcctgtagtcaaaagctactcaagaggttgaattgggaggatcacttaagtccaggaattcaaggtgagcctgaggaatattgcaagaccctgtctctgtaaaaaaaaagataaataaaataaaaataataaaaagtttaatgaaaaaaagaaaaaaaactataaaaaatgggcaagggagttatatagacatttttccaaagatgacatacacgtggccaacaggtacatgaaaagatacccaacatcactgatcattagaaaaatacaaatcaaaacctcaatgagataccacctaacacccattaggatagctactattccccccaatcccccacccaaaaaaaccccagaagatggcaaatgttggtggggatgtggaggcattggaaaccctgtgaatggctggcgggatagcaaaatggtgtgattaccatgaaaaacagcatgatggtttctcacaaatttaaaaataccgttaccatatgacccagcaacctcacttctgagtacatatccaaaagaaataaaagaaggctctcgaagagatatttgcaaaccaatgttcatgacagcattatccacaatagccaagaggtggaagcaacccaaatatccatcaatgaatgaatagataaacaaaatttggtatatatacatgatggaatactatgcagcctcaaaaaggaagaaaatcctgtcacaagctataacatagatgaaccttgaggacaaatactgtagattccacctacatgaggtttctggaggagtcaaactcatagaaacagaaagtggaaggaatgatggttacctggagctatggggaagggaaaaggagagctgttggttaatgggtattgagtttcagttctgcaaggtgaaagagttctggaggtctgtttcacaacaagagtgaaactccgtctcaaaaaaaaaaacatggttaagattttaaaaatagtccagtgaaacatacaatgatcctttctgttatccatcacccagctcccaaaatcaacagttcaaggtcacgatctgagattactttaggcaaaatctgtgtagaggtagggatagactgatgacttttttcattcattatccttctgctggtaacttaacctcgaatcctaatctttttgtaacctaatttctttgttcttcttttttgtttctttttagacagagtcttgctctgtcacccaggttggagtgcagtggcctgatctcggctcactgcaacctctgcctcctgggttcaagagattctcatgcctcagcctcctgagtagctgggattacaggtgcccaccaccacgcccggctaatttttttgtatttttagtagagacggggtttcaccctgttggccaggctggtcatgaactcttgaccttgtggtcacctgccttggcctcccaatgcattgggattacaggcatgagccaccacgcctggccacaactcacccggctaatttttgtatttttattttattttattttattttttgagacagagtcttgctctgtcacccaggctggagtgcagtggcatgatctcagctcactgcaacctccacctcccaggttcaggagattctcatgcctcagcctcctgagtagctggtattacaggtgcccgccaccacgcttggccaattttggtatttttagtagagaccgggtctcaccatgctggccaggctggtctcaaactcctgacctcaggtgatccacctgccttggcctcccgaagtgctgggattacaggattacaggcctggcccctttttgtaacctaatttgtgaagtgacatcatactcaagggaagggagttacataagggtgggaatctcagcaggagaagatcactgagggccaccccagaggttgcccaccacactatgggactattatttgaaagctgtagctttagcacttacgcttagcatgtttttaccataacttttattaggtgctttgaataaccatttcatgaggtattggtctttccattttacagctgactgtattatgtaatgtgttcaagttcacagaacaataatcataattagaactcatacatctcagactactgttttttattttgcagggtatatttttattactattacatgaaaatcatattatttaacatcaaagtgttctatggcactatatcaataatgggttttggagaaattttctttttggattgttacttgtaaacgtactcttctttgtatgtcacaattggtatgtttgaatcagaatgtacatattacatttgggtgttacaatatctcaagtttcttttgattttgagtcctcttcttccaacgcatctaaaattttttttatttttaatttttgtgggtacatattaggtatatacattcatggtgccctacttatttaaaacatgtcattgacttatagaagatacttgtttaattgatgtataaaatatctcacatcctggatttgcttgtttgctccctcctggtgtcatttaactttacattccccagcattttctgtaaatgaaagctttggaagcttgagtagattcaggttcaatttctttggcaagaatagttcgtaggtcatatagacattagtacagaactccctacaaaatgcaagcaatgttggattattccaggaagcatttggaatctctctcaaaaactcacaataatagggaataaaaatagccctagtgtccagccactagcttcaacttttctctcctccttgctaatgttagccagcattgattacctatttttgtcattgtccaagcagatatcataagccaagaacctcgctgaatatacaatgtgcactgaagaacaagtagatatatatctttcttgttttttatcacaagcgacagaaacaaactgtgcctaacattaaaagtactgtattaaaaggttgtaagatggatttatgctttcaccacccgtattcaacatagtactggaaatcctagcaagagaaatcaggcaagagaaaggaataaaaggcatccaaatgggaaaagaaggagtcaaattgtccctctttgcagatgacatgcttatatttagaaaaatctctatggtgtcagactccttatacaaagaaaaaaaaaatagaaaaacctagactctaccacaaaactcttagaactaatagacaaattaagtaaagtatcaggatgcaaaatcaacatacaaaaatcagtagtgtttctatataccaatgaagaactggctgaaatataaatcaagaaggcaatcccacgtacaataactatgcacacacaaaaactctgcacacaaatttaaccaagaaggtgaaagctctctacagggaaaactacaaagcactgatgaaagaaattgtcgaggacacaaacaaaaggaaagacaccctatgctcacggattggaagaattagaattgttaaaatggccatactacccaaagcaatctacagattaatgaatctaccaaaataccagtgacattcttcatagaaagaaaaacaaccctaaaattcacatgaaaccaaaaaggagcctgaatagccaaagcaatcttgagcaaaaagaacaaagctggaggcatttttccatctgacttctgaacatattacaaggctacaataacccaaacagcactgtactggtataaaaatagacacatagaccagtggaacagaatagagaacccagaaataaatccacatatttatagccaactgatttatgacaaaggtgccaataacatacactgaggaaaggacaccctcttcaataaatggtgctgggaaaactggactgtcataggcgaaagaatgaaagtagacctctgtctctcaccatatacaacaatcaactcaagatggattaaagacttaaatgtaaggccccaaactgtagaactactagaaggaaacactccaggacattggtctaggcaaatattttatggctaagacctcaaaaacagaggcaactaaaacaaatagacaaatgggactatattaaattaaaaggcttctgcacagcacagaaaatcaacagaatgaagagataacctgttgaatgggagaaaatatttacaaactattcatctgacaagagaataatatgcagaatatacaagaaactcaactcagcagtgaaaaatctggccgggtgcggtggtgcacacctgtaatcccagcattttgggaggccaaggcgggcggatcacctgaggttaagagtttgagaccagcctggccaacatggtgaaaccccatttctactaaaaatacaaaaattagcctggcatggtggcatgcacccgtaatcccagccactcaggaggttgaggcacaagaatcgcttgaactcaggagtcagaggttgcagcgagctgagatcgtgccactgcactccagcctgggtgacagagcgagactttgtttcaaaataaaataaaataaaataaaataaaataaaataaaataaagctatgatcagcacaacacaaatatccttattcattcattaatttgttcaatagttatttataagttctaccatattttactcactgctctggtctcaagcattaataagacgttgattagaacagggccaaggacagagccctattgtacctactcccagaaatacgttggctgtgaatcagctctttagagaacagggttattttatctgttatcacttcacctaacctatttcctctagcatccctaactccattttgtttaggaacatgtcttcaggcttttggcacgtgccttaatgaagtgagatccacactgtcaagcatcccacctttttccagactagtagattctgtgtttctaacaacactgtggaccaggatgtgggtgtgaactaggtgtacacctcagctttgcacttcttgctgtgaacctgtggcaagtcacttcaattctcagagcctcaggttcctcatctccaaagagggcaacaaacccaatcttgcaaggctgttatgagaattagacataatatacgtaaaatgtccagtacatactacttgtttttcccccttatttcaggtcagtttctgggagcacagatcatacgtactactttttgaacttgcatataaaaaaaattagaaaagcagcactgaattccagttaggggaaattagatttttttcaattcctatataaattcatgagaagttttaattcaagaatttacaaatcagagaaatagtatatacaaaaatgattatcaaatattaagactattatcttgaatttcaatgagttttgtatttatttaaaatatacaatatatggtcattgtagttatatataatgttagcttactatcattattgtattaatatgcaataaaagactttcccaaggctcagtgaaaactaagcacattttattttctctgtgtttcatatgtaaaataaacaccttgtacaggattctggaaagatgctatgctatgccatttttttttttttgttattctaaaaggaaggtaaccagacactgctcgaagaacttaaatatttgcatctggtttttaaaaagtagagagaaacaaaaagctgacaactatatctagagagggatatcagttcgggggaaagaagggaggcaggctgctttttcactatatagctgttgtaacttttgaattttgtaccttgtgcatatattattattattttatttattatttatttatttatttatttttttttttgagatggagtctcgctctgtcacccaggctggagtgcagtggtgcgatctcagcccactgcaactctgcctctcgggttcaagtgattctcctgcctcagcctcccgagtagctgggattacaggcgcccgccaccatgctcaactaatttttgtatttttagtagagacggggtttcaccgtattggccaggctggtctcgaatttctgaccttgtgatccgcccgcctcagcctcccaaagtgctgggattacaggcgtgagccactgattgaaaaaatagttaatctttttaaatagtggcaaaataattttaaataacactatccttttcactgagtttacttctataaaatctgaaagccttaaatacaaagaaggcaaactaaattccctgaaaagtcccattcaagtctgataatatatggattaaatcagttaaatgaaccacattaaaatagattgactttataacaatttctaatctctgcctgctggacattcaaatgaaaactaaactgtttctacaaagatgcccaattcattgcaaatattttaccaagaacaccaaaattttaaacacggacactttttagatacaatgaacaggatagtaagctatattgattgattgattgattgactgactttgagacagagtcttgctctgttgcacagactggagtgcagtggcacagcctcggctcactgctacctccgcctcctgagtttaagcgattctcctacctctgcctcctgaatagctgggattacagatgcccgctaccacacccagctaatttttatatttttagtagagatggggtttcaccatgttggccagggtggtctcaaactcctgacctcaggtgacctgcctgccttggcctcccaaagtgctgagattacaggcatgagccaccatgcctggctagtaagctagatttagacattaaaattcaaaatctatttttttagaatagtttgggcaactgtataagatttgtgattgtatatttgattgttgctgataaaattgtatatgaacaatcaacaatttacataaaccctgactgcctatttaaggcaaataaaacaagagttttctaaacaggattgtgcacaagagagagatattaaaaattttggccgggcacagtggctcatgcctataatgccaacactttgggaggctgaggtgggaggatcacttgaggccagcagtttgagaccaacctgggcaacacagggagaccctgtctctactaaaaatacaaaaattagccagacgtggtggcacacacctgtagtcctagttactcaggaggctgaggcaagaggatcgcttgagcccaggagtttgatgttgcagtgagctataattgtgccactgcactccagcttgagagacagagtgagaccttgtctaaaaagaaaaaaaagcgaccctcccatctcagccccctaagtagctgggactgcaggcgtgtgccactcactacatccggctaattttttgcatgtttagtagagacgggtttcgccacgttgcccaggctggtcttgaactccggctcaaacaatctgcctgcctcagcctccaaaattgttgggattataggcctgagccattgcacgccagccaggagacatagattatcagtagacactcaatggatgatggctcagaatttcttttcactttgtttagttaaccagaagaaaatgatttatttcttgccatagtcatataaaacaatttgcttttaaactactatgaaaggcctggcgtggtgactcaggcctgtaatcccagcacattgacaggctgaggtgggtggatcgcttgagtccaggggtttgagaccagcctggacaacatagtgagtcctcatcctacaaaaaataaacataaagttagctgggtgtggtggaatgagcctgtagtcccagttacttgggaggctgaggtgggaaggtcacttgagcgtgggaggtagaggctgcagtgagccatgatcatgccactgcactccagcctgggtgacagtgtgagacctcgccttaaaaaggaaagaagaaagaaagaaaaaagaaagagagaaagaaggagagaaaaagaaagaaagaaagagaaagaaagaaagaaagaaaaagaaagaaaaagaaagaaagaaagaaagaagaaagaaagaaaggagggagggagggagggagagaggaagggaggaaggaaggaaggaaggaaaagaaagagaaagagaaaagaaaacagaaataagctaaatatgagatttgatgctaagcaaatatagttgtgttgggagaaaagttcccccaacttgcctggtgcaatggtattacctcccttgtgaagttcctggcactatagtaggtacccagccaaaataagaccccttcctgcttccacgtcaacctcagtagccaaggtttcgtaactcctgcctttaaactgaagaaactgtatcaatgtctcgtaatgtaatagttccatagctggcagtaaagaaaaccaaacttaaagagccacttgagcagaggagatagaccaaatctgttgtattggttggcattcagggaaaactcaaagtcaaaaggcaccatctcaagaccatccagaaaagctcgttgggcccttgatccagaaagcacccagttggtctcctagagagcactgtagggattctgaaatcattacacgtggtttttaacccagccccagttggatgcagatataagaaccaagaatttgccctgtaggtgtatgacgagttgcttcttcataagttgcgttgagacccagcaggcaaagacacacctgttcaaagctaatattctgttaaacaataaccagggactactcatgaagttcctccagatgtctgaagactcccaggggcgaaaggccccaacggaaaggcctggcagttgttcaaaagccacactggattactacagcttccagccgctcaaattgaaactgcccaggtcgaagagttctaggagcagtgtagtgaccctttaactacatgctactttaacctgcatcttccaaactctttgaattttttttttcttttccaggacacgaaaaaaattcagaataataaaaaaaaagaatagcagtaactactttttcctgtgttactgcttgtgccagaccctgtagaagtgcataatatgctacgtcaactccatcaatatttcttcataacaatctgcaaggaagtattattgttcttattttacaaatgaaaaacctgagtctcagagaggtttggtagtttgctgaagttcacgtagctaacaagtggcaaaggtaggatgtgaattcaggatggattggcatgaatacccacgatctttactctcagtacacagcttcatacttacatgcagggttacaatgtgcttggtaaggcaagaaatctctaccaacacaggatttttttgaggattaactaagaaaacataaataagcacacagcctgttgcctgatacacgttaggaactaagtaaatgcttattttgttttaaaatcattaccctacattctggaaaatgtgccatggaatgggacgggcccacaatggtttttctatagagtttttagcgggttctggggacaactattatatattttaaaatagcaacgctcacatgctccatagtaaatcagttggccaagttaaaaatagattctaaacatagcaagagcagaaattcaatctaagatactaagtcatggaaagcagttgacagtggttgcaacagagaaaaggaagcgcaggcacacactgattctacatgtggataaaattctccaacctccatttcaggtttgttctattctctatagcagaaaacatgcacacatatatatgcatacatgcatatacatatgcatgcaaataaataaactaagatgacacattctatttatctgcaatagcaccatttacaaacctattaattttgagattttggtacttattagcacgtactagatacactacaacaatatatagttcctcaacatttttaggtgtaagagagaggatggttaatgtttaaaatatttggggtgcagatacacagatggctagactggtagataactagaaaggatggggacagaagctatataccctctgtgctcagtcaatttacagtggcagccttagagagttgggttaatgctgccattctgtcatttgaaaccccgggaactggtatgccagataaaactgcaatcactgtgccaaggactcaggaaaaggcgtggagcttaggttctccctcagcctcctacttttaaactgttgtttggagcacacaattactttctctcagttgctagggtgggtgcttcagctgtgggtgtcactatttagggaggaagccatgaaatgtatatccttaaatcacatagtcttgttccatgtacgtcaagaagagaatgactgagggatgtctattataaactggagtaatggcacatcacaccaaataaaactttccatgggatactaacataaaagcagatccattataaatataaaagaagaatgatacagagaagatcagcatggtccctgagcaaggatgatacatgaattcatgaagctttccatatttttaaaaacaccaaagcaggccggggcggtggctcacgcctgtgatcccagcactttgggaggccgaggcgggtggatcatctgaggtcaggagttcgagaccatccgggtcaacatggtgaaatcccctctctactaaaaatacaaaaaatgagccaggctcggtggctcacgcctgtaatctcagcactttgggagggtgaggtgggcggatcatctgaggtcaggagttcgagaccattctggccaacatggtgaaaccctgtctctactaaaaatacaaaaaattagctgggcgtggtggcacgtgcctgtaatcccagctattcgggagggtgaggcaggagaattgcttgaacccgggaagcagagactgcagtgagccgagatcgcgccactgcactccagcctggtcgacaaagcgagactgattctgtcttaaaaaaaacaaaacaaaacaccaaaataacaacaaaaaaacctacagaaagacttatgacacaattgataatttaggatcaataactttctcctttttttaaaaacaaaagcttgaaatatatttatttgtaaaacaccatgtgaaatagaataattgaggataaaaacacaggagagtggttagcagtgcaggtgttggagtcaggctacttgtgtttggtcaatactaactgcaggtctttggacaagaagtctcgcttctctaggtcacggtgtcctaaaatgtcatagtatacacttcatagagtcattgtggctgttaaagtcctatatgctagccatgatcctagcacatagcattctaaacattagctattaccattttctaaaagtaacagaggcaagagattactaaatacttgagataagcggattactgtaattgaggactgattttcctagaagctaaggaaaaaaaaaaggttttactttctgacaaagaaacaatcagcatacatcagtgaagactgcccaaacttaaataggagattagtaaaggaatctttgaatacaggacattgcatcaaatagcaggtatcgcaatgacagctttgcacaccgcagaaataattgtttacgtgtagtgcctgctgtccactctctaaaagagctgagggggtagggcactatattgtaactcatgtagaggaactgagacatatgctccaaattctttgccttctgacttcttatggttaggacacggaaaaatccagaaaactgaacatatgaaacttgcaaatgactgatatcttaagtgtatgttcggcagaagcggatcatgctttattcataattaagttatctaaatttttggctcaacaagtatttgtttccgacattgaacaaaggtatatggcttataaggatgaataagacgcattattctttttgcccttatatggtccacatgaggattaaagaaacaccacatgctggtcaggcgcggtggctcacgcctgtaatctcagcactttgagaggccgagatgggctgatcacctgaggttgggagtttgagaccagcctgaccaacatggagaaaccccatctctactaataatacaaaaattatccgggtgtggtggcgcatgcctgtaatcccagctactggggaggctgaagcaggagaatcgcttgaatctgggaggtggaagttgcagtgagtcaagatcatgccattgcactccagcctgggcaaccagagtgaaactctgtctctgaaaaaagaacaaaaaacaaaaacaaacaaacaaacaaaacatgctttagatacttgaggtaagggaaggaaatctcaaatggaaataagagtcaaatttctaagctgggcacggtggagcacacctgtaatcccagcactttgggaggctaaggcaggaggatcgcttgagcccaggagttcgagaccagccagggcaacagagtgaaactcctgtctcaataaaataaataaataaataatgaaaaaatgtaaaaagaaatttctgctgtcctcccagatgcaaggccagttggtgctgcagggaataaggttgcctaaagatagaatcatgacagcattttacttaggaaagagctatggatgaacttgaatacttggataagttcatggttaatatgtcagattacatatgccacataatataaggaaattgttataccatgaaaaaagttaagaccggttaattcagcccttctctttatttgcaaattggccctgtaaactttgtctagtttcaggaactgttggagggattttggaatcagatttaatcgctcctggtctgtgctacttaacttgcaagcatttctctgatatagtattaggttggtgcaaaattaattgcggtttttgccattacttttaatggcaaaacagcaattacttttgcaccaaccgaatacttttcttattgtgctttctttcacctgtagagtccaaggtacttgttcattaattgagccaaattatttaggtttaaaaaaagagttctgggacacagctctcttcgacgtggagatggatgtcttggatggatgaatatattaattaatccagtatttcctgaattttttcagttatacattatgatatggtttggatttctgtccccgcccaaatctcatgtcgaattgtaatcccccatgttggaggagggtcctggtgggaggtgatgggatcatggaggtggatttcccccttgctgttctcgtgatagtgagtgagttctctcgtgatctggttgtttaaaggtgtgtagtccctccccctgctccctcttcccctttctccagcctcatcacaggtgctgcttccccttcaccctctgccgtgattgtaaatttcctgaggcctccccagccatgcttcctgtacagcctgttggactgtgagtcagttaaacctcttttctttatacattatccagtcttgggtagttctttacagcaattcgagaatgaactaatacactttacttcttttttctctctctctgtctcctcccaggctggagtgcggtggcatgatcatagcttactgcagcctcgaactcctggactcaagccaccctactgcctttggcctcccaaagcgctgagattacatgtgtaagccactgtacctagccacccttcacttctgatttttgtcaggtccatgttacttgtactattagataccaacattttctttaatttgacataaattgtccaatttttaaaacatagtctcatcgtaagcaatgatatctgtgaaatctgagtttgaggcagatgtttaaatataccttaaaataaaaacaactatataaataaattaaaatcatgagccacataaaatagccttccactcactttggaaaacaaagtattaatcaattaataaaattttgaactggaaaggtctcttttagattttctaatccaactcagagttccacagagattcagccaaagtcaccagctgagggaagagttgggagtagagcctcagtctacggtttagtgtgaaaagtttagggctttctttaccatgtttgttgcaaattatgcccccaactagctgaacagctatttaaatataagcattcctatcaaatacaatgattttagtttgggtataaatggtgccaaagtaattcttctgttggtagctaataggtctgactgcttaagctcactaaaatacttattttcttatttgcggaagcaatagctctctctaattatttaaaaattatcaaataaactggattcagtggtgtgtgcctgtagtcccacctactcaggaggctgaagtgggaggattgcctgaggcctgaagtccaagaccacacccacacatacgtgcgtgcacgggtgagtgttatagaataaaaagaatgggttacactaattcatttgtttatttttttttgagagggggttcttgctctgtcactcaggctggagtgcaatggtgtgatctcagctcactgcaacctccatctcccaggttcaagtgattctcttgcttcagcctctggagtagctgggattacaagtgcacaccaccacgcccagctaattttttgtgtttttagtagagacggggttttgccatgttggcctgcccgatctcaaactcctgacctcgtgatccgcccacctcggcctcccaaagtgttgggattacaggcaaaagccaccgtgcccagcctacactaatttaaaatgttactaataggggagaccggtggggaggcaggcagaaaggaggtataggggaactctacattttgcttaattattttgtaaagctaaatctgctctaaagataaagtctaatagtaaaagcaaagatagaatgatattgaagcatagtcctctttaaaaataggaatgtgtctagctgagatcactctcttctactttatcttagcaatagtgttttgctacggactatgatgaagcattaagggccaggagcggtcaaggttggacagtttggcccatttatggtttagtacagatatggagggcatgtaggtgtctaggccctggattggaagtgaaatttgcccttaacattatcaacacagtgatcctatttcacatttttgatccccaaattctttttttttttttttttttgagacggagtctcgctctgtcgccccggctggagtgcaggggcgcgatctcggctcactgcaagctccgccacccgggttcacgccattctcctgcctcagcctcccgagtagctgggactacaggcgcccgccaccacgcctggctaattttttgtatttttagtagagacggagtttcaccgtgttggccaggatggtctcgatctcctgacctcatgatccgcccgcctcggcctcccaaagtgctgggatgacaggcgtgagccaccgcgcccggctgatccccaaattctattagtgttattactaggtgatacttacggaaaatagacaatgattatcctaagatttcaaagcataagtattaagtggtaaaaatgtcatacccgttttaaagaaaggggggcgtagaggcctaacattcctaaatgacactggggcaaaaatagaaataaaatccaggtgtctagggcctggctttcccatcgttgccgttcattgttaaagtgatcattaaacaataacaatacaaagaaagacagggtcatagtcttatgagcactcatattttaaagagaaaggcgttaaaaagaagctatacaggagcctcaattctgcataggcatggttttttaagatgatttagggaaggttttgtgtttgttgccattagttttaaaagtattaaattcttggttatatcctttttttaaaaaattgtatttgccctaatcatataacatgaaaaacgtacgatcaaggcaaaaaaataaagtgctaggtttagttatttggtttcaaataagccacaactagtatgaaatttctagttaatattctacttaaaggtctacaaattcaaaggccttgagacccacttaaggcaccgaaataaaataacttagtgaataaacttagccaaattacttaaatccctaatcccttgctttttacaaataggaatacctcaccacttgtctcctgggaaagatactattagtctattctgatgacacttctatggcattttggattgccagttgataattttcaaaaaaggtagatacaaaccattgctgggtatgctgtggccatgatgagggcatagtatacatgctgtatactatttgaaggagaatgtagttttggtgggtgagtgtctcaagtttgtgggtcattgttaccagctgtaaaaggacctcagcaactgcagagcagttatcaggtttgtgtactccctgttggacctagaagacagtcctgcacctagtaggtgctccagaagcattttctgaatgccgagtgaatcgtccccctccaagactggagagggaggctaaaatgaacaagagcccccccaggagtttgtgcctgccttccttttactacttggtgaggaaggattacgaatatgtaagaaatgagaggcactagagaatgaagtaaacccttcaacagttacccagctgtcccttggcctgacttcccctagctccatgccccaaatgcaactcacttttcccttccatccaagccttcctaaaaataacttccttttctaacttctcactcctgtcaccactattcatttccaagtctcacaccttcccttacctccttgaaaatatagctgacctgaaaaaaaaaggcggggcggggggtaagggtgggggaagagtgtagagaaaaacccagccaaactgtgaagatgttttactgttacgtgtttgcactgcattgcgtagtgacgttctctgttgaaaatggggctgcagatgcttgttctagggtagttactaggtaatgtgggactttaggaaggagttagcttccaactcacaagaatatttagtctcaactgatttttattcttaagcatcttattaagtgtaagtgtccataacccaggcctgcacagtcaaggtcaggtactgcattgagtcattctctgctcaatttttttccttgccccacctctactgtaaccttttaaaaaaataagatacaaggtttcactgtcacacaggtacgcagtacagtggcaagatcattaacctcgaactcctggcctcaagcaatcctcctgtctctcagcctcccaaaggaggcatgagccaccgtgtctggctcaattttctggtcaattttaaggctcaaaatagtattgtaattgctcataatataaaacatagtacaaattcagtttttactacttatctgcttgttgaatgcgtattgcaatttaaaaatccacatactgccgggcacagtggctcatgtctgcaatcctaacactttgggaggctgaagagggtggatcacttgaggtcaggagtttgagaccagcctggccaacatagcaaaaccccgtctctactaaaaatacaaaaattagccaggcatggtggcgcatgcctgtaatcccagctacttgggaggctgaggcaggagaatcacttgaacccaggaggcagaggttgcagtgagccgagatcatgctactgcactccagcctgggcgaaagagagagactctgtctcataataataataataataataataaaataaaaataaaaatctacatactgtatacatataactgtttattcagacccaggatatttttcctttgtcctgtcagagcctcatggactaccattcatctggggaaactctgggaaggaaaattaattatagtgctggcagcattggaatggtcaggtgacagagaagccacgtgtgccacgtgtcaggcatctcctcttaccatctcagagggactcacgaactttctgaatcaggagccatgtttgtaaaaattttctaacattccagaacctttataatatttctgcttgctaattttattatcctatctctttccccatagctcagcagtaaaactctttaaataattttttttttttaaaaaagtacatgattacattcaagggtaacaaggagggtggaagctagaaagattgggggactctagcccccttcacagtgcccctcatctgtcaccccattggatggtgtatgcctccctccgggggagaaaagcaggctaagcccctggggcttgatacacggaggaaaagaaaaaatccagagtaagattctgaggcacaacctggaagagactcttggggctgagcagtagagaggctttgcctttcagagaagcaatttggggatcttaactcttggtttcctcatgtttcatatggaaatattagtatatttcttacagggctattgtgatgattacataagatagtccatgtaaaatgcttgacatacttcctagaacacagtaaatgctccaaacattaccactattggccctcgagtcactggagggtgacacggacatagtccagaaaaagtaaatcaaggcctggtgcggtggctcacacctgtaatcccagcactttggaaggccaaggtgggtggatcatttgaggccaggagttcaagaccagcctggccaacatggtgaaacctccatctctactgaaaatacaaatattatctgggcgtggtggctgcatgcctgtaattccagctacttgggagcctgaggtatgagaattgcttgaacccaggaggcagagtttgcagtgagccgagatggtgccagtgcactccagcctgggtgacagagtgagactatgtctcacaaaattaataaataaattaaaattaaaatcaaatcaagccacaagtaagagagaactatagattgcctccatgtccaaaatggtgaatcaaggccggacacagtggctcacgcccgtaaccccagcactgtgggaggctgagttggatggatcacttgaggtcaggaatttgagaccagccagagcatggcggcacacgcttgtaatttctgctactcaggaggctgaggcacaagaattgcttgaacccaggaggcagaggtttcagtgagccgagattgcaccactatactctagcctgagtgacagagtgagactgcctcaaaaaaacaaaaacaaaaatggtgactcatcttcttatctccattttacagatggggaaactgatgttacagagaggaagtaacatgtccaaagttttctagctaatgagtagtggactgagattcaatcctggacccctttacctcctaagaccatttccttgttcttctatacagcattatctcctgatgtaaatgttaacataaatgaaacctaatttcaaagatttatttttggagctggaactaacaaaacattccaaaatcaattagcagcatatttttacacttttcctctatttttacacatgaggacgaagaggtcgtgtgagcaaccataaacacgtattgaatctttggatcagctaccatccttcacctttaaggttttattttcaataaataaagaacagagacttagcctggcaataagtgtgcctgaaaaatgctggttgggataggaagtgtttaagtaatgaattaaatcgtgacttgctgtgtcaaggtctatattaaagagaaacataaaggaacatgtgcttttgagagaaacagggccagcgtgtgatttttccaaatgctttaagagctgtggtttcatgtaagtgttactcgcaagctgcccacaaatgctgccacccgggcttcctgtgccgggtctccctggaaagcctgaacgagctttggcactgaaaatgatcttgtccagggccaagaatttaacacaattaaatttctccctcttgactgagaggcctgaaacctaaagctgcagaaaggcgggaaggaaagagaagtatgaaggcgagagcccactactagctcatggtagaggagtaaatttcgcctccactcctgccttccaagagccagcatccggccagacgtttagtttccctctttgtctttccagacgaggacaaagtgcatgccactatctggttctttcaagtctctaagagtctctgccagatgcttgggttgatattttgaagcagtaaaaaagaaagaaaagcagagagagaggtgactaattctgtggagaatgtttgctcttaacattcttctctaaatatttgggttattgaaaggatctaacaatatcttattttataaagaagcagaaaaacagtgatggctgggcccagtggctcatgcctgtaatctcagcactttaggaggctgaggtaggattgcttgaggtcaggagttcaagaccagtcaggacaacatagggagactccatctttacaaaaaataaaaaattagctggccatggttaatcctggttagcacacctgtagtcccagctacttgggaggctgaagtgggagaatgacttgagtctgggaggtcaaggctgcagtgagcccaccactgcactccagcttgggcaacagagcgagactttgtctcaaacaaagaaacaaacaaacaaacagacagacaaaacagtgactctgaaatcagaactagattcctaaccagctctcttatttactggctgtgagctttaaccaagccatttatgtgaagatgtggtatttttatctgtgaaacgtgaatactaatacaatacaaagtacctcatgcagcttaataaagaagaactacttttattattataactgtaatgaaactatgtccttattctgttgtattctgataaggatttccttttgagatcataagctcagggactcatctatgaggaggggtggtgtcttccatgaagggctggatatttttgatgatgatcattcagggaaggcatgtaccctcagttaggaaactgaaattagaccagagaactacctccctccctctcactgtcctgcatctacagctcaaggaatccagatacccttacaggccctcctgaatagcaaggtggaaacaaggaaggggccacaagctgaagatgataagctgtacggtgtaaaccagatcgcatgtcatacaggcagcagattacagcagtgaagggtagaaaccctgaagtcagaacatctcccgttgtgcatttgaagcattagaaaagcaaactctcctagtggaaggtgaatttcaggacagaaggtggggtttggcgtctgagtgcttctgcccaggtggaatggggcttatttcagtagatttccttgcaagtcctttaaacttctcgaagctttcagttacatctattgcgcctcgtgaaaactctaaaataggaagtttggacattgttacttctatttttatgagttaataagttttaaagagattacatgactcgcccaggatcatgagattagtaaatggcaatgcccaaggaaaatccagtttttttaaaaaaaaattattcccagtccagatttcaattatctccatattaggaaagtaaacagggcatgaaggatttttaaactatcattttgcattattcccaccacttaccctttccacttcactcacatcttaggtaactgagtcaactgcattcaaaagaaacatttttggggggagaggggagggatagcattaggagatataccgaatgtaaacgacgagttaatgggtccagcacaccaacatggcacatatatacatacgtaacaaacctgcacgttgtgcacatgtatcctagaacttaaagtatgattaaaaaaaagtaaaaataagtaaataaataaattcctttaaacaaaaagaaacattttctgtgttcctcacggacacatcactgatggctgtctgaacagattcaactcactataaattcaagcatgcaaaaggacataacctgtacatatccacctggctccatagagtaattaagcaaataagtgtcattgtctaaaactatgtgcttgcttttctgatttagccctaagtttatatatccatgagtgggatcaaaaacgattttccgattctaaatttctgaaaatcacgatgagatgtttaagtgaaaaaatgctttggcagcatacaatattacaagttactcaagtattacaagttaacaagttactcaagctatagctcagaagccatatacatatatatgtgtatatatgtagagtatatatgtatatatacacatatatgtagagtatacatatacgtagatgtatatatactctacatatatgtatacgtatacatatacgtatatgtatacgtatatgtatatatacatctatctatctatctatctatatatatatatatattttttaagatggagtcttgctctgtcacccaggctggagtgcaatgccatgatcttggctcactgcaacctctgcctcctgggttcaagtgattcttctgcctcagcctcctgagtagctaggactacaggcttgcagcactatgcccacctaatgtttgtacttttagtagagacggggttacaccatattggccaggttggtctcgaactcctggcctcgtgatctgcccacctcggcctcccaaagtgctgggtatacaggcatgagccaccgtgcccggccgcaaaatatattctgaggaataaaaatgattgtagttagttttccacagtccaaagcaagctaataatatttaaagagttaaaagtgtaatataatcatcggtcatgtttctacaaccaaagagagttgaaaggagtcaaatatcagcataatgcagataatgtactcactggcattgtgggcctttattatttggataatcattttcaccttgtggagacttttccagaattatatacttttatgcctaatcagcaaattaggcagttgaaaagtatgtatgaagcagctaatatgtgccccaattaggctaggtagtgtgggtatataaaaagggtttataaagggggaggctcctattcaaaccttagtggggtcaggagatgcggaagttaattaacatatattaaatatttttttactcacccacacctagagaaacagtactgttttaaatgtgctgtaggagttcagagaaatactgattaatgtggtttggaataaattaaataataaaaagctttgctgaatacagttagtttaaaaaatataaaaatatagggggatttgcagagaaatctgttcaactcttaaaataatttttaatttatatatgtttatataagaattccattttattaacatgaaatactagtacctttttttggggatggagtcttgctctgtcatctgggctggagtgcagtggcggatctcggctcactgcaacctctgcctcctgggttcaagcgattcttctgtctcagcctcccgagtagctgggattacaggcgtgagccaccacattcggctaatttttctatttttagtagagatggggttttaccatgttggccaggtgggtctttaactcatgacctgaagtgatccacccgcttcagcctcccaaagtgctgagattatgcgtgagccaccgcgcctggcccagtacttttactgatgaaaaatgtaatgtaaaaggaaggtctgtcttacatacaataagtgctgaatctgggtcttttttaaaaaaagtcattgagaagacttactcctttcttaagttttaagacatttattattgcaaacagaaaaattgtactagataccggggatatataaacgaataatgccgtttctgtcttcaagatcttactgtttggtaggtggaaataaagtgaacgaacgaaggcactgcaaatcaatgtgggaggctctataagcatggggccacagaggaaaaggctgagagggaaagcttcaatgactaggtgacttcaaaaaggtcatcctggccaggcacagtggctcacacctgtaatcccagaactttgggagggccaggcaggcggcagatcgcttgagctcaggagtttgagagcagcctgggcaacatggggaaactctgtctctacaaaaaatacaaaaactagccagacatggtggcgcgcgccgctcctcccagctacttgggaggttgcggtgggagggtcacttgagaccgggaggcggaagttgcagtgagcagagatcacaccactgcactccatcctggacgacagagcgagaccctgtctcgaaaaacaaaagacaaaaacaaaaacaaaggtcatcctgcaggacaaccaggagggcacaaatgtgtgtctgtgggaagctgaaatgttggcgggggaaaaaagcagggaaaggcattccagaaaaaggaaactgtaaacagcacacgaaaaagcatagtgaatgaataggaagcctgagaccaaacttagggtttcctacacttatttcaaagcccttcattatctatatggaaagggggagtctttaaacacaaatatttagatcatattgactgagatttagatataaatgaatgctaataattacttttcgttattttggggtgttaaacatttactgtacaagattgtattcgttttaagtatcttctaacatgagccattttgtaatgattcagttgtttatattcaatttcaagtagaatgctgatcacagcgccaaatgggtatcttctacagaaaaagttattttaataaagaaaaatatagtcagttttaggatttcctgagagattatagaaacaataaaagcattaaaactgttaagtcattaaatacgagtaccttgtattttgaaggctcttaaaatttagtttataaattgcttttacataacatatgcactgaaataccacttaagattagttttgaaaataggtgttcgtttcaaccacatcattaggtattttattcaaagctctttataaaaagagctttactatgttccagtatagtaaacttatccagaaaataagacaaaaatttaacttcatgctatagctgcaaagttttcggaaagcgggatttaaaacttccattgtaactttaactagcggtcatgtcaaatttcacaactaagaacattttaacgcatgtaatactgagcacaacatgggcacgtttttgttgctatgagaaccttctattttgtattagacattgcagccttgacgacgcaatgtttgtgctattttgcgcatgttttcctgcagctattcctctcctctagcaatagtcgaatggctctggtttcctcttgcgcccggcccagtttttccgttttagcttcggttgtcataggctgtgctgtcgctttctctgggaaaggacggtgaagactggacgggagaaaccgggagggcaggcgcggccgttctgcagcagccgggccgcttcccggcgggaggcgggctgcgaatgggaagcgggaggaggaggccgggccgcgggctggttctatcacccccttgggagcccagctcttcacctagctctccggcgcttttcaaaatctgcagttaacaacaaaaatcgagcaacgccacgtcgcacaaacaggacaggagggggcgaggggtgtgtgcgcgcgcgtgctgtccccaaatggatgagaaataagggaaaggaggggttggggaccgtgtgatgaagcaacatgctaggcccgggacaagtccggctccggcctcgggtctggagggacaaggccgggggccgggtggcagacggggcctctggtcttcccccagcgcgagggtcgtggcgcgaaacggggacagggcgcgcgctcggagcctcctccccgccccgccccgcccaagggtcttcctcccccgggattcagagcggcccctcctccaggccaggctcgccgcggggcgctgagcaggccgggacaccgcggccgaggttatcgttaggcatctcccaggcgaccggctccgcagcaagatggcggacgagaaggacagggaaggtaaggtaggggagccggggagccgctgccctcgccgcccgccgcgaccccgggctgcacggggaagcgccgggtggggtgggccctcgtccatctggagttcccacccgcagggaaagggcggcctgaggagggggccacccggcagcagcagtcgccctgcccccgtccccgtagcccgcccggcccgccgctccgccccgccccgccccgcctctctcccccgccccgccccgcctctctcccctcttccctccctcttctctctcccctcctcccgccttcttctttctcctcccgccctcttcaccctcttcccctcctcccgccccgtcctccttccccctccctcggaggccgggccttgcatcctgcgcgggctgcgccggaggcgccggcagggggtgctgataatggcgtcgttgttcacggtcgcggggaagccgccgccgcctccacactctcgcctggggtctcggtgccgcaggcgccacgcccgtagctgtccaggctgtgggccccggggggtggcctgggtgaggaggagttctggccgcctgaatctgacgggatcctctgtttgcgccgaaaccccgcgctggcgcagcctgatggcgttcgcggccaccattttgcctccttaatgaggacgcaggaggacggtctggaggtcacagccgctgcctccgagcttcccggtcctccgaaatgcctgccccgccgccggctagcgccgcgcaattggcctagtgtcttgtcttaaaaaaaaaaaaagacacacacccaaacagcaattttaataacgacgaaaaaccaaaacctggttgagatcttggaaccgctgtgcgccggccgggcctctcccaggggaccacccagccccgcgcggtggccgcctgcagaggcgggactgcgcttcgaggcttaaggtcgccagttcggaggcatcgatgtgttgtctgtgcggagaagccaaaaagtgattacgtttatttgcaagaccgttcatgttgttttcagttcatggtatgattaaaacccgatcctttgttaccatgcccttaggtactaaaaaataattgtgtttgatagttggcagtcacccaaaaatatccaaaaagccatgaaacagtaaaggtaaacaagtaggaagtgaaaataatattcgtcctttgttttctttctggagtgctcaaaacaccctctcaaaccatttttctcagcatagaaccaagtgtggtcaggttaacagctaatatttacaagggaagaaacgaaccctgagatatttagtcacttgttccggtgatcacagaaaatcggcgaagaaacacatgaaactgccaacgatctctctattgataacaaggataccgtgatttttatgtaatattaatctgagaagccaggattattttgtaggtattagctttacgaagatgcccttacatacaaagaaaaggataattttaaaactttcccagaaaaatggatggcttatttttgttctttaccaaaaaaaaaaaaaaaaaagccattaggagataaactagcaaggtaattatggatatttattttcttaaaaaagacttggttaggtcagcatgagaaaaaacgcactggagtatggtacaaatacagtatttctcgttttttaaaaactgagagctttcctgatttttcagcttttgaacaatttttttccatttaaagtaaattcagagaaacaattttgtcgataactcatagaagtaatgactgttaaaagctggatgccattcattcagaatacatatattcaatgccattatgtagataaggcattctacttagaactttgaaagatacgaaaatgaaagacattgtctttgcttccaaggaaggtgagatgagtaagggagatgagaaatttacaaatgggaggaaatagttaactgggctgagtagtctgggtgccaaccactgtgctaggtgtgtatccttgtagtccgtggacagcagcctggacatcactggctgccaccgacctaataatgaatcagtcttcattttaacatgtttgtaggtgatttgtatgtacattaactttcgagaaggccgggcgcggtggctcacgcctgcaatcccagcactttgggaggctgaggcgggcggatcacgaggtcaagagatcgagaccatcctggccaacatggtgaaccccgtctctactaaaaatacaaaaattagctgggcgtggtggcacgccctgtagtcccagctactcaggaggctgagacaggagaattgcttgaaccggggaggcggaggctgcagtgagccaagatcacaccactgcactccagcctggcgacagagtaagactccgtctcaaaaaaaaaaaaaaacaaaaacaaaaaacaaagttcgagaagcactcatgtgctgtatctcatttattgttaacagttttatggattaactaattgcagtttgtgaagggtattatgaaataaaggcattttgttagaggataaactaagtagagactcattttggtggtaagatctttttatggaaatagtctattactatatttgattgtcagctactgtattttgaattttcagaaattacgtctaaccaattaatcagaattgattaagttttgaggattcactcaactaaactcataaaagactgatgtgcaaacctgaatgatttattaatttaaataagggtatatacattgacttgaaggctgattttgccaatatactaatataataattttggcaatatactaatataataatatactgttttatgggtactaagcttcgggtagtgtgaatttgtatttcagaagtcatttgatgaccgtggaatcacacaaaagaaaggataattttgaaggatgtgttcagtaccctctaagttccaaaagatctgggaccatttctgatctgttaatactgagtgttgtgcagagtgcttggaacgtggtaggtaatcaataaatatttgttgaattcagaacatttgaattaatcaaagacagcttatgagattttaaccaaagcattcctagctattttccccaaacttattctatacctaaaagtacacaaaactcgttttaggtctcttttcccctctgctttaccggtaagatacattcttctattccatctggctcaacaaaacgttttatttcacagtgccacggtattcactagcatgtctttaaaaaacaactacaaaaaacctcattgtagaaatacacatatgttttaaatagttcatccttaatattgagatttctaaaagttctaaagggggaataagtttcagggtacctatcctatccactcttcttcaatatttagagattaactttgatagaagtattgagaatattgataagaaaaattacctaaattagaaggggctattgtgctcataaaatttttttctaagattatgtacgttgaagttgttatacttatttgtagcattttttgctttcatacagtataatttattttttcatagattaaaaattatacagaattatattagctaaaagtttaacctttagaaccaaattatttttaaaaccacttttttaactgaaagaagaatgtttgaaacgggatgagaaaaaatatttttgaaggtttattatttttccaaagtttcctcagccagaacattttttgttttgttctttcttttccttctgttttgtctgtttaaatggagagtcaatgcaattgttgattctttggctccttaaatcttattgtttctgtctcttagagaattttatataggactggaaggatcttctgtttgtaattagactcacgtctaggaaacaaactgcttagttataaaatttgaacttttggcagccagtgagctttggaaagtaagaactttttagtaagctgcagatattaaaagctcactctaggatttactatttttgtttctattaaaatattctttgttactttgcgtgctttgataacattgcttgataaagtgcctctaattcaattatcacctcctaaatggaagaggttttacaaggtttgttgttttgtttctgatttccttcattgtgccactcttttgaaaacccaacatttggaaatataaagtaaaaaacagaaatttcaggtgcctattactttataaaaagggttcccttaaataacgtctttgttttttttttcttcttttattttgagacagggtcttgctctgctgcccaggctggaatgtggtggtgcaacctctgttgcctaagctggaatgtagtggtgccatcacggctcactacagcctcgacctcctgggctcaagcgattcccccgacctcagcctcccaagtagctgggactacaggcgcaagccaccatgcccgactaatttttttaatttgtagagacagggtttcactgtgttggctacgctggtctcaaactctttattttttttatttttattttttttttgagatggagtctcgctctgtcgcccaggctggagtgcagtggcacgatcttggctcactgcaagctctgcctcccaggttcacaccattctcctgcctcagcctcccgagtagctgggactacaggtgcctgccaccacgcccggctaattttttgtatttttagtagtgatggggtttcaccgtattagccaggatggtctcgatctcctgaccttgtgatccgcccacctcggcctcccaaagtgctgggattacaggcgtgagccaccacgcctggctcgaactcttgagctcaagtgatctgcctgccttggcctcccaaagtgctgagattacaggcatgagccaccctgcctggcctcatagtaactgtcgatagtatagagtgtagcctgtgggacagtacaaaggttgagctttgaagtaagacttgaatttgaattccgtcttccccaagctctaattatctgatcttagccgagatgctaaacataagtagcttcaagttcctcagatgtaaagtggggataattatacccccaatatttcataatgttgtaatggggacaatgttttcttattcatttttacatccccagcacctgccacagtgcctggcatcaaaggaatgctgaggccggctcacgcctgtaatcctagcactttgagaggcccaggcaggtggatcacttgaggtcaggagttcaaaaccagcctggccaacatggtgaaaccctgtctctactaaaaatacaaaaaattagctgagtgtggtggcgcgtgcctgtaatcccaactactcaggaggctgaggcaggagaatcgcttgaacccaggaggtggaggttgcagtgagctgagatcacactactgcactccagcctgagtaacagggtgagactctgtctcaaaataaataaataaataaataaaaaatacaataaaggaatgctgaataaatgggaaagaaagtgtttggtacgtatctagtgaattagtaagtattagtatctgcttaacataaaacataagagttggccaggcgtggtggctcctgcttgtaattccagcactttgggaggccgaggtggggagatcacctgaggtcaggagttcgagaccagcctgaccaacatggtgaaacgctctctctacgaaaaatacaaaaattagttgggtgtggtggtggttgcctgttatcccagctactctagaggttgaggcaggagaattgcttgaacctgggggatggaggttgcagtgagcctagatcgcagcattgcactccagcccaggcaacagagcaagactccatctcaaaacaaaaaaacaaataaaacataagagttaagaaaacttttaagtcttaccaattgggatcatgcataatgcattcctgcatatttctggggtaatttaataagttttcttcctgttttagaccaatataaatatccggttaagactaagcaaacaagaagactagctttttgaagcctaatttgtttcctcttattcagaataaaaaaaaatttgaagaaaaactggactgaaatttgtttttgctctgatatataaaatttacagaaatgtctcaagaatagtcataattttaaagatcaaatggacagtgagatactacctcacgcctgttaggaaggctattatcaccagaagtcccccaaataataagtattggtgaggatgtggagaaactggaaccctcgtggactgttggtggcaatgagaaatggtgcagctactatggaaagtggtatggcggttcctcagaaagttaaaagttgagttaccatgtgacccagcagttccacgtgtgggtatatatccacagtaattgaaagcaaggcctcgaagagatatttgcacaaccatgttcatagcacattgttcacagtaggtaaaaggtggaagcaagccaagtgtccatcagcggatgaatgaacaaaccaaatgtggtatatacgtgtagtgaaatattattcagccttcaaaggaggaaattctgacacatgctaccgcttgaatgaacctgaaagacatcatgctaagtgaaataagccagtcaaaaagacaaatactctgtgattccacttacatgaggtacctagagaagtcaaattcatggagacagaaagtagattgctggttgccaggggctgtggggagaggagaatgggaagttgtttaaggagtgtagagttccagttctgcaagatgaaggaagttctggagattggttgcccagcagtgtgaaggtacttaacactattgaactatatggttaaaagtggttaatacagtaagttttacattatgtgtattttaccacattttagtaaatagaaaatgttgagtacattcagaatgaaagaaatggtacattgtttttcaaaggcaatttggaaatttgtattgaagaataaatgatgatggctaggcaaggtggctcacatctgtaaactcagcactttgggaggctgaggtaggaggattacttgagaccaggagttcgagaccagcctgggcaacatgctgagacctcatctttgctaaaaataaaataaataataataaagaagtcgggggttccctctgttggctttggagcccccatccctctgtctctgtacagggaagcttcttccttctcctttcttgctccttcttgcctgttaaactctctatttcttaaaaccaaaaaaataaaaaataataataaaaagtgatgtccacatgctttgagctttaatatacttctggatatttatccttagaaatatattctgaaaagaataaaaaatgctctaagcacaaaaatgatcaacataaagttatctataaatttgaaaatatagataacatttgcatgtccaactaatggggcatacaaaataaatggttgtatgtccacttgttgggttgcagccaaatatataaaaattatatgtgtaaatgggtaaggacacgtgggggagcccaggagatgatgatgatagcagggtgattagacttttaggggcacttatttttaaaatctcattttaatgtcagttctacaaaactttaaaaacccacttaaatatgctaattaaaaattattcttacccacttgtgaaagtgtgtttaccagatcctgtacttgacaatcctttgtaaacctctagtatggattttatagatattaagactgtaaaaaagtaattttagtttttatttttattttttaagagatgagatctaggccgggcgcagtggctcacgcctgtaatctcagcactttgggaggctgaggctggcggatcgcctgaggttggaaattcaagaccagcctggccaacacgggaaaaccccgtctctattaaaaatacaaaattagctgggcatggtggcgcatgcctgttatcccagctactcgggaggctgaggtaggagaatcacttgaacccgggaggcggaggttgtgatgagctgagagcaccattttactccagcctaggcaacaagagcggaactccgtctcaaaaaaaaaaaaaaaagagacgaggtctcactctgtcaccctggctggggtgcagtggcttgatcacagctcactgtagcctctactttctgggctcaagtgatcttcccactttggcctcccaagtagctgggactgcaggggcgtgccactgtgcccaactaacatttttatttttggtagagataagatcttgctctgttgcccaggctagtctcaaactcctggcctcaggcaatcctaccaccttggcctcccaaagtgctgggattacaggcttgagccaccacctctggcccataattttatttttttaaatgcactagtaaaattgggagtttaaaaacctggactagaatttggacattgcctttttttttattctttttaagattttgcttgttagtgtcaatttatctgacctttggtttgaagaatttccatctaaagaggaagataggcagctaaggagacaatgatacaataatgtgataagtgctatgatagttgcacatgtatgatgattgggtgcctggggagagtcacctgattcacacacaccctctttaaattatagcccctttttattccctctcatagctatttgtttttttcctctttcatactatattttgtaattgcctgtagatgtgttgtttgatgtctgcttctcctagactcttaacttccaaaaggataggggtcatgctcatgcatatacccagagcatggcatatagctcagtatttgctgaatgttgaatcaaagttggctttctgaaggagataaccgaagcttatcttttttttttttttttttttttttttttttgagacgtagtcttgctcttgtcgcccaggttggaatgcagtggcgtgatctcggctcactgcaacctctgcctcctgggttcaagcgattcttatgtctcagcctcccaagtagctgggattacagacatgtgccaccatgctgggctcatttttttatatttttagtagacggggtttcaccatactggccagtctggtctcgaactcctgacctcaaatgatccgcctgccttggcctcccaaagtactaggattacaggtgtgagccactgcgcctggcctaatttttgtatttttagtagagacggggtttcaccatgttggccaggctggtctggaactcctgacctcatgtgatccgcccaccttggcctcccaaagtgttggtattacaggtgtgagccacgactcccagccccaggcttatcttgaaggtgtaatagcacagagaacaagtaggggatggatatttcaggaagagaagaaataacatacttgaaattgtgaagactcaatatggccgaaatttaggatgggttaggagatgtgggaatttttattcttaaagcattggtgagtgattaaaagtttttaacaaggccgggtgcagtggctcacgcctgtaatcccagcactttgggaggccgaggcaggtggatcacgaggtcaggagatcaagaccattctggctaacacggtgaaaccccgtctctactaaaaaaaaaaaaaaaaaaaaaaaaaaaaattagctgggcgtggtggcaggtgcctgtagtcccaggtacttgggaggctgaggcaggacaatggcgtggacccaggaggtggaggttgcagtgagccgagatcacgccactgcactccagcaagggcaacacagcgagactccgtctcaaaaaaaaaaaaaaaaaagtttttaacaagatgggaggctgaggcaggataatcacttgaacccgggaggtggaggttgcagtgagccaggattgcaccactgaactccagcgtggctgacagaatgagactctgtctaaaaaataaaaatgaaaaaataaaaaataaagttttttttagcaagagacaatcatatttgttgtctagaaaaatcacttgggcaagtgtgctcagtggattagatggactccaggtttgggactccaggtttgtcccagtatagtagtccagaaagataaaaccctgaaccaaagtaatggaagtcaggaatgaaacaaggagataggctagaggaaatggatagattttgtaataggacagatatgaatattgagtcaggtcagggacacggtttctgattgggtaacaaagaataaagaggaatagtagagttatgtaaataatagttctagtcttgcacatgttgagtttgggtgcctgtgaggcattcaggttgagatataacataggcagcactgtgtgcttggtacctaaatatctgttgaatgaaaaatgagaatgatgtgtgttggatcgcttgaatgtattcctctgtaagtggttgtagtcttgggaatggttgagaatgtccagaaaaaatggatacaattttgttgactgaggccgggcgtggtggttcacgcctgtaatcccagcaccttgggaggcccaggcgggtggattacctgaggtaggcagttcgagaccagcctgaccaacatggcaaaaccccctctctacccaaaacacaaaaattagccaggtgtggtggcaggcgtctgtaatcccagctacttgagaggctgaggcaggagaatcgcttgaacctggggaggcagaggttgcagtgagccgagatcacgccattgcactccagcctggatgacagagtgagactctctgtccccaccccaccaccccaccgccaaaaaaaaatgttgactgaaaggagaagtgactaggatcagaactctgggtaaaaatcagtaattgaacagagaaaaataacttgtgaataagattgaaagcacaattgcaaaatcatgggaaaatgagcaaatagtgtcacaaaagccaagtaggaagaatttcatgaaggaagcacttaaaaatgttgggaaaaactccccaatggttaacatttatagagcacttactctgaagtaggcactgggctgaatgttttacgtgtattatgtcctttaatccttacaataaatctatgtggtaggtgcctctgttacccgctttccacaagtaaggaaatggaggcttagataggtaaagcagccttccagtttcagctcaaaaggtaagcgcttggaagtcatcactccggttgctcctggagccataaactgcaagaaatatttgttaattttgacaaattggtggaggctgcgtgtggactgtcatgagagtgagaaactcctggaggcctgcagtcttaggcggtccctcacacttcctccggttttactcctaggaaccccacggggttattctggtgaagagccaagcaaggttggtttaacaggggaaggggaaagcaacgcttttgaaatatgctagtgcattcttcataaaaaggccaatttcagtggccgctagtctggtcttatctcaacggatggaaaaagctgaaaaacacttgtgaaggtcacagcccattgacacaggtccactaaaagactgagatttcatcgtaagttgatagaattctcctcacccatccctcaccaccacatcaacaggaatacaactcagaccaactgacagcggcttgcagctggaagacctacaaggtggagactctatttaaggacaagttcttagggaagcctgaagaggaatctggcacctacagctacagcaaacattaaacacagccctactcctagccagattggggtaaagcctcacactagtagctgattactatcatgtctggcttccaacaaaaaatgacaagacatgctaataggcaagaaaaacagcccgaagagacaaagcaagcatcagaaccagacttagatatatgataatgggtgttttgtaattatcaaggaatttaaagaactgtgattaatatgttaaaggttcaggccgggcttggtgacgcatgcctgtaatcccagcactttgggaggccaaggagggtgggtcacttgaggttaggagtgtgagaccagcctagccaacatggcaaaaccccatctctacaaaaagacaaaaattagccaggcgtggtggcgtgtgcctgtagtcccagctacttgtgaggctgaggcaggagaatcactcggaccctggagtccatagactcaatgtggctgaggaaagaatcattgagcttgaaggtatgtcactagaaactttccaaactgaattgcaaagagagaaaagaatgaaaaaacaacacccaagaaccatgggataatttaaaaggtgtgaaataacatgtaattgaatgccagaaggaaaagaaagaatagagcagaagaaatatttgaaaaaatgggctgagcgggcccagcactttgggaggctgaggcgggtggatcacctgaggtcaggagatcgagaccagcctggccaacatggtgaaaccctgtctgtactaaaaataaaaatacaaaaaattagccaggtgtggtggtgggtgcctgtaatcttagctacttgggagcctgaggcagaagaatttcttgaatccaggaggcagaggttgcaatgagctgatatcgcgccattgcaagagggtgagactccaatctcctagggaaaaaaaaagaagaaaatcatctggaaagcttgttaaaacatagattgttgggtctcaccctcagtaatctggagtgagggggtctggaaatttgcatttctaacaagttaccacaggatgagcatgctgttaagaaacattgatctaaaatttaaagtgaattttgccatttcagtgtatttccttctaggttttgtctaggcagatttgtattttgttttgttttacaaacttgagatgatattgaatatggttttatgtccagcttttttcacttactattagaaacattttttcatgtcacaagtatttcttaaagacatataaaggagttgcattcattatattaggttggtgcaaaagtaattgtggtttttgctattaaaagtaatcgggcctggcgtggtagctcacacctgtaattccagcactttgggaggctgaggtgggcggaccacttgaggtcaggagtttgagaccagcctggccatcatggtgaaaccctgtctctactaaaaatacaaaaattagccagttgtggtggcgcatgcttgtaatcccagctactcgggaggccgaggcaggagaatcacttgtactcaggaggcggaggttgcagtgagccaaggtcatgccattgtactccagcctgggcagtagagcaagactctgtctcaaaaaaaaaaaaaaaaaaaagtaaccggaaataccgcaattacttttgcaccaacttaacctaacattaatacttatggtcactatgatttacttaaggtttgtctaactgttagatatttaaattgtttaaaaatgttctgttgtaaatgttcttatacaaggattttttttttgacccagctttgatcctcatcctctacccactttggaaaaatttcttttttttctggagagacagggtttctctctgtcatccaggctggagtgcagtggcccaatcttagctcactgcagcctcaaactcctgtgctcaagcggtcctcccacctcagactcctgagtagctgggactacaggtgtatgccaccgtacctggctaatttttttggggggggggaataattttgttgaatcccatctctggtgggtcttcctagttacagaggataacccaatttcccaattctgtgagtaccttgtgatccttttgtattaattacattatttctctccaattttaaagaaatcaatcatagacccacatattgccattcagagcttatgatcaggataaaatacagatttgcttattgtctctctatcctgttacagtggaaatgataggaaactagatattttgtttcttttgttactaaatccctggatttagaaaatgtgtaggatatagtaatcactgtaaatatttgttgcaagaatgcaggaaccaggagtagcacattgatggcaccttgcatcttcttattaagagtaaatgtatttttctgtgaatccttttaaaatactgaaaataggctatgtgtggtggctcacacctgtaatcccagcactttgggaaattgaggcaggtggatcacctgaggtcaggagttcgagaccagcctggccaacacagagaaaccctgtctctactaaaagtataaaaatgagccaggtgtggtggcacacgcctgtagtcccagctactcgggaggctgaggcaggagaatcgcttgaacctgggaggtggaggttgcggtgagccgagatcatgccactacactccagcctgggcgacagagcaagactctgtcaaaaaacacccccccttcaaaaaaaaaaaaaaactccctcaatttcctgacacatacgtgtttatctgtacttactggctccttacaaaaacctcttacctggtttacttgttttcatttattatgctgtaaatctggttattggttaatgaattctctacctaaaatccttaatgtcttcccattacccttaggatagtctgaattctaacaaaacagacaaggatgtcttctgtctccagggttttttttttttttttttttttctgattacatgtgtggtatcaccattcacgcattctacacttcattatacgcttcatcatagagagcaatttctttgttgttcctgtaatgaaagtgctagcctgcgcacatattgtttccttatcccagacttcatttagtaaatagcattgcttagtggttaagaacatgaagtctgtagttaatccttatgggctcaaattctggctttgccactttagagctggataactttaggcaaggtacttaggtgttctaatttcttcacatgtcaaatgaggagcatagcagagcctgtcccatgtggtggtaaaggatgttgtggagaacttcacatgccgtaagagctctagaaatgttatgagtccttacttaccgtgttaggcctggtgctagatgttggggaataaaacagatttgggccctgtcctcttagatattgctgtagaggagagaaccattaaagagttacataattattgggccaggtgtggtggcacacacctgtaatcccaatactttgggaggccaaggtgggcagatcactcgaggccaggagttcaagaccagcctggctaatgtggtgaaacccccgtctctactaaaatacaaaaattagccaggcatggtggcacacacctgtaatctgagctacttgggaggcggaggcatgagaattgcttgaacccgggaggcagaggttgcagtgagccgagatcgtgccactgaactccagcctgggcaacagagggagactccatctcaaaaaaaaaaaaaatacataattgttataagcagttcaaaaaagttcagggttccacaaaagggacatctgatttaaatttttcttttttctttcttttatttttttttcagacagagtttcactcttgttgcccaggctgaagtacagtggcatgatctcagctcaccacaacctccacctcccaggttcaagtgattcttatgcctcagcctcccgagtagctgggattacaggcgtgtgccaccatgcctggctaattttatatttttagtagagacggggtttctccatgttggtcaggctggtcttgaactcctgacctcaggtgacccgcccacctcggcctcccaaagtgctgggattacaggcatgagccaccatgcctggtctgatttaaatttttcttacttcagtggctttgaatgtgacatttcctctaccaaaaactactactagtaacagatggaactgcgaatttacaagcctgaagtaagaaaggagcatagcttattagaggagttgcacgaggctccattgtggctggaatggagacatgaaggtgggaagaatggtgtgaaatgaagtttgaaagtaggcagaggccaggtctttgtgaagaccaggtcagggaggctgacttctatacaagagcaagagggagccattggagctttttaaacagggaaatgatacaattcattatgtttttaagaggtcacttggccagatgtgatggcacgagcctggagtcccagctacttgggaggctgaggtgggaggattgcttgagcctagaagttcgaggatgcagtgagctatgatcacacctgtgaatagccactgcactccagcctgggtaacatagtgagaccctgtctcaaaaaaaaaaaaaaaaaagatcacttgcttgcactgtggaagggtggagcacggcaagagcagataatgatggtggtgtcttggattagacagcagcggaggaaatggcagagaaggtttgagagtcaagagagtctaaacgtttttgtgactggatgtggggactggaggagacagggatgaatgaacacctttcagtccaacttctgactcttgcttctcatctttatctaaggtccatcctcaagtctgaggtgggtgccactcttgtgcctccgtagggctgtctgtgtatgtcactaagttttagcactgatctgttgtgatttactatagctggtctgttttccttttaagttagaatgtatttatagtagatggtagctgatcaacaaacatttcataaatgaaagcacagattaacataaaagtagatgatgattgagtacagtatttctttctttttttttttttgagatggagtcttgctctgtcgctctggctggagtgcaatggcgcgttctcagctcactacaacctccacctcccgggttcaagcaattctcattcctccgccttccgagtagctgagattacaggcgtgcatcaccacacctggctaatttttttttgtatttttagtagacatggggtttcaccatgttggccaggctggtttcgaactcctgacctcaagtgatccgcccacctcagcctgccaaagtgctgggattacaggtgtgagccacagctacggtatttcattttaagcctagtgttttggtggtatattgtctttggatcaagttgtttatgaaaaaagaattctcaaagaactattcctaccacctctctcccctgacccccccagccaaaggccaagaattggattcttgatttttttttttttgacagcatatgtctggaatatgtattggtattaattgggtcaaatagaacaataacattatctgtactttcagttaattaaccttgagggcatttctttaccttcttttttgtatgctttaaacagttcccatggtaagtattcctcttggggcttattattttatcttaatttctgtaggtgggattttgagtatctaattagatatttaaatatgtaaacagacatctccatgttagaaaaaactcagctgcactatttgtttaaaaaacttctcttatatccttaggtgatttgacttgtgttttgttatgactgctcctttgtatttattatcattaatttgttctttcgaaattaagtttaactttttttgttgtttttctcctatggtttagattttaacttagtgcaatatgtagttttttagtctttgcagcatttccattgatggaaaacaaatacagtgtgaaattgttggctttcatatacccaatatggaattaaagtgaaaagggaactatttaatttattatttttttaaatgagatcgggtcccactatgttgcctaggctggccttgaactcttgggctcaagcgatcctcccgccttagcctcctgggtagctagagaattattatataatggtataacttgcctcaactgggatttttatcaattaagtggcattttgttattatattgacatactaatttagttatatttattttataataagcaacactgctgtttatattttgtggcctattagagtaggaacaactaaaaataaggtaaataatatatttttaaaggagcatgaaataaaaaattttatttaatatttaggaaagatgatatgcgtatccaacccattgcaaaaattatagtaattgctagttccaaaatattgttagtgaaatgtcatcagattcctataaggcttatatcttcatgaaaagtaatgctaataacactgagtgtgacattagacctttgcctgttttctctctttccatatatgcttcctgtgaatgactaatagaaaacttattttctctcaaccaaatctgtgtaacttactttcctgagatactaggcaacttccctacgttacaaaaaattagtaatgataatgggtaactttgattgaatattcctatagttcaggtggtaaccctcaaaacaaccttgtcagctagatactcgatattgtgcttttcacagatgagaaaaactgaatatttgagcagttatttatcctaaagattacagagctatgtacgtatgaatatgtaagaatatgatctttaaaccaggtggtctggttctagagtctgtgatcttaaccatgacactgtattgcaacctagaaatggtggcaaaatttgttcaaagtacaatgttaataaagtaattttgatttatttagttattatttatttattttttgtagagacaaggacccactttgttgtccaggctggtcttgaattcctgggcacaagcgattctcccaccttggcctcccgaagtgttgggattacaggcatgagtcaccacaccaggccaataaagtaattttaaaaattaactaaagtccatactttactcagattttcttaatttttacctaatgtccttttctgctccggagtcccatcaaggacaccaggttaccatttagttgctatggctccttcggctcctcttggctgtgatcgtttctcaggttttccttgtctttaatgacctccttgacagttttcagaatgggtcagaatgcccctctattagaatttgatgtttgtgtcctgattagactggtggaatgggattttaggagggagaccacagagttaaagtaccattttcatcacatgacatcaaggttatgtactattaatatcaatacaattgatcactgttgatgttagcctcgatcgcctggctgaggtagtgtttgtctggtttctccactgtggtaactctgtctccccattccgtagtctttggaaggaagtcatatgtgcagcccacactcaaggagtatggagttatgcttccctccttgagggcagagaatctacatgaattatttgaaattcttctgaacagaagatttgtatcttttctcctatatatttatttacagtttcctctattcatggtttggctttccgtggttttagttaactaaggtcaaccaagatctgaaaatattaaatggaaaattccagaaataaaccattcattttaaattgcatgctattttgagtatcatgacgaaatctctctctgtcctaccaggatgtgaatcatcgctttgtccagtttatccacattgtatatgctacctgtctttaatcattgacatcttctgcttctgacatttaaccatgaacattgtcatggctcgggatgacccgggatctcccaaggcaggtgctcttccttttggtgtatcatcaggtcaacagtagcctgacactgcatcatggtgctctgtgtcattcacctcacttcatctcatcacgtgggcattttatcgtctcacatatgacaagacgcatgagtacagtacaataagatattttgagagaggccattcatatagcttccattacagtatgttgttatgattattctattttattattggttactgttgttaatttcttaatgtgcttaatttatcacaggcatgtatgaataggggaaaacatagtatatatagggcttggtgttatctgaggttttaggcacccactgcaggtcttgggacttatccctcgtggataaggggagactactgcacttgatcattcattcctgtcagtatggacacattggatgtttattttatactttgggttatgagccagtactactttattcattttgttgctcaaattgtttcagctttggccattggaagctcttttcgctggctcctatgtcactatgacatagccccatcaaggtgtggtgtttttggggggttttattgagacagtgtcttgctctgttgcccaggctggaatctcgatttactgcaacctccgcctcccaggctcaagcagtcttcccacctcagccttcctagcagctgggactacaggcatgagccactgcgcctggcctaatgtgggtggtgtttttttttttgtacttctactactactactactactgctaggatctagttctactcagtacttctggcaccaaatgtgtgggttttccacaccaaacaattctccagttccctgtggacaccaactgggagtcctacaattcaactcaatttaataccaactacccagagttactacagatcccacaggttaaggatttggtcccacaagaccattccctaggaaagtaggctaactgctgattaaaggtagtggatccttaagttactcacacttcagttagatgtggctacaaattgggggtttccataacccccttcttagttccataatttgctataaaggttcacagaactcaaggaaacactttgtttaacatttactggtttatcataaaggatgcaaatgaagaaacagatggagtgacataaagggtgcggtgagctctgccaggtaccccagctgaggagcttctgttctgtggagttgggtgcactattctcccggcatgtggatgtgcttgccattccagagctcttggaacccctttgtttagggtttttgtgggggttccattatgtaggcatggttggttcgatcactggccattcgagattcgctcaatccccagcctcttccctctctggaggtcacagggtggggtcaggtttggggaatgagtcagaatttttggcagataatttctattttgtattagctttctggattattctgattccattattgtaacttgtttactatggtccagctttatgccctttgtatacattatgacttttaatcctcgtaacagccctgtgaggtagagaaatagagcagtaggagtcagggcctgtttggtcagcattttgctattaccacctttttaaacttttataggagtggctctgaatctctagaaagtcatgtaaagatcttgatatttatttaaaatcataaacaaatattcacaaggaaactttttttcttgacattcagtatgttttaagtaattttcatgtggttcgagccttgtaaaggtttttctggttttcatagtgtagaaagtaaagaaagctgttacaattgactgtctggactgatttattcaagagaaaatcacttggtttatagaaggcctttaacattttgtgagtatgtgttttaaaccaaaacccatagataggaagagccgacagggagctggaaactgcaataagctttcttctaactagcaaacgcagttgacagacatctttttatagacgtatctgtgattgcacgctgtttttaggcttgataattttttcaacaaggaaaaacttttcttcaatttgaaaaagctgtttacagtaaaatggcaaagtatgagaagacagaaagccatcctgctcattctaaagctaaattgggccacatttcccttaaagtatagacaacagcagcagtggaacacagttaagtgtgtgtttagtgaaggaaagttttttgaatactgccgccacaataatttttcaaaccttgaattctttattgagaaagtgacaaatcagtgagagagggaaagggaaaagaaaattaattgaatttgcaaaatttcttaaacaactaggattacagaagtaaaagaatgaatttgaaggctgggcgcagtggctcactcctataatcccagcattttgggaggctcaggcgggcagattacaggaggccaggagtttgagaccagcttggccaacatgctgaaaccctgtctctactaaaaatacaaaaaattagctaggcatggtggtacccatctgtaatcccagctactctggaggctgaggctggagaatcacttgaacctgggaggcgaaggttgcagtgagccgagattgtgccactgcaccgcagcctgggcaacagagtgagactgtgtctcaaaaaaagcccccaaaaaaacaaaaaacaaaaagaatgaatttgacgtagtgcctgtgtcagttagctattgctctgtaaccaattactcccaaatctagcagctaaaacccacaaatatttattatctctcataatttctggctgtagctttactgggtgattgtgcctaagggtctctcatagtctggggctcactcacatgacttttggcaggaagccttggttccttattggttgttggctggaggcctcagtttcttgacacatgagactctctataggccacttgactgtacatgcaacattgcatctggtatcccatagagtgagtcattcaagagacagaaagagatgacacagaagccacaatatcttttataacataatctcagaagtaaccaaacattacttttgctctattctattggtgacataaactaaccctatataatatcagtggtgactgcgcagtggtataaatagcaagaggtgagggtcatcgggaaccatctcagaggctggctaccacagtctgccttctggcctccagtgattcacgtttctcgcacatgtagaatgcactcactctctccaaaggcccactagaatgggccttccgtcccattacagccattacagcatcagctcaaagtccagaatatcatatctaaatcaagcccaggtggtaatgaggttccttggctgtagctacttatgtatgacttcttgagtggtttctcttgatctatagacctgtgaactagagagatgttacttgccccttaccactcaacatacaatgggaaaaggtaacatccacagacacttctatcaaaaaagaggatgtcttcgtgtatttgtgctgctgtaacaggataccacagactaggtaacttatgaagaacataaatttatttctcacatttctggaggctggaaagtccgagattgagggtctgcatctggtgagggccttcttgctgcatcataacatggtagaaggcatcatatggggatggggaaggaggctgaactcattcttgttaaggaacccactcctgctataacatacgtgctcctaagataacagcattaatccattcatgagggcagagccctcgtggcctaatcacctcttaagcttccacctcccaaaacttgcatgggggtttcagtttccaacacacgaactttggggatacattttttttttggtatactttttggtattcctccatagtaaggaggaaatgggaggaacacaggagtcgtggttcataaaactgagcctggcaagtattggacatttattgattaggactcagtcttactgtccagaagtgattctaggtggcctttagctctgtcccctgagctcttggttagactctttgtcatcttttcttttacgagaagtagtacatgtttacagctaagcagttttctaagcctgattcctgtcaatagaagttttgggagtccaaagaacgtttttccttttgtaatctctttgtcatttttagttcaggcttaaggtgtttctgcaaatagcttccttttaaaatttttcataggtctcccacgaatcttattgtccattagacaaaagccatatacacaaatttgtttgagataagctgttctctgtctttggctcctactaagatagctaagagacattaaacttctttttttattttttttcttagatggagtcttgctctgttacccaggctggagtgcagtggcacaatctcggctcattgtaacctccgcctcctgggctcaagtgagtctcctgcctcagcctcccaagtagctgggtctataggtgcatgccaccatgcctggctaatttttgtatttttagtagtgatggggtttcaccatattggccaggctggtctcaaactcctgacctcgtgatctgccggcctcagcctcccaaagtgctgggattacaggtgtgagcccctgcgcctgggacattaaacttctttttaaaccctgttgtttgagtgaaaggatctgtaagactcaccctcaaactttctagagattctttgctagtctgaatgttgccttgatgcaccacatttggtaattctgaagtcttaagaaaggactgtagaaccatatactgtattatgttttcctggcagtgccctaaatttgatctttaagaagccacttcttagtgttttcttgccatctggagatctagggaattttcacaactagcaattcctggctccttgttgtttaacaggctttcctttaggttatctctcctcttgtattttattttttgtttgtttgtttaaaagagacaggttctcggccgggcgcggtggctcacacctgtcatccccacactttgggaggccaaggcgggcagatcatgaaatcaggagatccagaccatcctggccaacatggcgaaaccccgtctctactaaaaatacaaaaattagccgggcgtggtggcaggcgcctgtaaccccagctacttgggaggctaagtcaggagaatcgcttgaatccgggaggtggaggttgcagtgagccgagattgtgccactgcactccagcctgagtgacaagagcaagactccatctcaaaaaaaaaaaagagggacaggttctcactctatcccccaggctggattgcagtggtgcgatcatagctcactgtaaccttgaactccttgggctcaagcgattttcccacctcaccttcccgagtagcaagaactacaggtatgtgccactgtgcctcactatttttaaatttttttgtagagatgaggtctctctgtgttgctcaggctggccttaagtgattgtgatcctaccacctcagtctcccaaagtgtggatgacaggcatgagacaccgagcccacccatctcttgtattttattatgcgcaactggaaggaaccaggaagcaccttcagtgcttttcctggaaatccccttatctagattacccagtttattttctactttccatgttgatacaggtgacaatgttgcaaaatttctgctattgcataaaaaggatctctctttgcagtttccaatgtgattttcctcactttcccttaagctctaacctagagcctacggaagggccagtactgcttggctgcaaagcctctcccacatttttaggcatgtgttacgccagctccccgttttcccgtaccatacctctagatgttatctagtactattacctattagtcatctattttgtggtaacaaattacccccaaaacttagtggcttaagacaataaacatttattttttcacacagtttcttagggtcaggaatctagaagttgtttaattgggtggttctggctccgagtctctcatgaggttgtagtcaagatgttggctggggctgccgtaatctgatggattggttgggcagagactctgctttcctggggtttcccataggctgcttgagtgctgcttgagtggggttacccataggcagctggtttcccgcaggactcgtgataagaggggtgtgggggggccaacatgaaaatctagtatgaaagtgatgtgctgttacttctgccatattctgttggtcccatgggtcagccctggtgtattgtgaaaggggactgcacgaatgtgtgaaagccaggaggcgggaatcactggaagccatatggacgttaccaggaggcaggaatcactggaagctatctggacgttgtcttctacaaccctgtcttgaagaatttcgtagcctactgggcacgagtgcctacatgttctaagcattgtgttagactgtcacatgttgttgatttggcatttacaatccagaaaggaactgctacccccagttgaagtttaaagagatcaagtaacttgttcacgacagattcgaatctagcctgggaataaacgcttggagcctaggccttaggtaaaggagtggataaatattctatagcatcattgcctttgtatttaaatatgaattttcttcattatacttatgtttagcagcagccatttaatgtctattttatatgtggacacctctgctcaactgttttttcttgtattcccttctccatgcagtcaccccttggcatgtggcggggataggctccaggacctcctgtggataccaaaatccacggatgctgaagtcccttacataaaatggcagaatatttgcatataacctatgcacatcttcttgtatacttcaaatcatctctagatcagttataatacctaatacaatgtaaatgctgtataaatagtttttatactgtattgtttagggaataatgataaggaaaaaagactgtacatgttcagtacagatgcagttttttccccaaatattttcaatatacagttgaatccatgggtgtacagagggctgattgtgtagctctgacctttttattttttttaacctatcctatctcgttcttctactgactttccttccaacactttccatagagtcctttggagcgtcagacttactctaacgtgaataaacttctttacaaatactctttttatagactacccctctcatctctgtcttaactaaatcctggctttcctgctagaatgccactcttcggggaccatcttgaatgaaagctgttcattcttccataccattttgtcttcaagccagtaagctgaatcagtctacttccaattccaaatcattgttctttcaccctcatgtaaaaattcttcttcctttgaaattcgtgccatctttttttttttttttttggtttatttttattttttgagacggagtttcgctcttgttgcccaggctggagtgcaatggtgtgatctcggctcaccacaacctctgcctcctgggttcaagcaattctcctgcctcagcctcctgactagctgggattacaggcgccctccacgacacccagctaattttttgtatttttagtagaaacgaggtttcaccatgttggccaggctgattttgacttcttgacctcaggtgatccgcccacctcggcctcccaaagtgctggggttacaggtgtgagccactgtgtctggccctgaaattcgtgtcatcttaatcattttctgtcattctttgtcactgtcatttattagtctgcctgtagcttatcccttgtttatcaaagactttggcactcttttctcagttttctgtccatctcttccactatcattctgggtggcttcagtagccaggtggactaccatgcaacatgctagtttcatcatccttgttcttttcaactccagtgaccttcacttccacttctttccaacattttactatcatgacttttagactgtaagacactctgaaatcttgactccttcattctattgactgaccaccatctcctaatttccagaggtactctgctcccttacatatatatttattttatttttcttttttcttttgagaccaggtcttgctttgttctccaggctggagtacagtgatgcgatcacagctcactgcagcctcgaatggctgggctcaagcaatcatcccacctcagcctcctgagtagctgggactataggtgtgcaccactgcatttggctaattttaaaattttatttttagtagagatgaggtcttgctatgttgcccgggctggtcttgaactgagctcaagcaatccttccaccttggcctcctgaagtgctgggattccaggcgtgagccactgcgcccagctcccttacatatataataccggtgttggatcttaccaagatgtctaggctgacccccttcccccaattggcttatcagtcaaacaaatggctaatatcaaacgattctggctaatgaagtagaaaaggaatttattagaagatagtaggtagctcacaaaatcaacagggaagctggagaaccagcttggaaaatgggcaggaagcaaagaggcccagcagcatataccccagctaatgccatggcactaggacagtggttaatgtgctgttgctcctacattcttgctgttatttcttctgccattcccataaataattttaatactgtctctccatttttatattacctgcttaggattcaaaatcttgcacaagaacatctgattggctgagtataggtcacatgcctattcctttgctaccagggagctgggagaggaaagatctgccttctttggcttacttagtgagaaggtagacacttttctgccaatattatacataataggattccctcaaaagacaacgaatgtttggatcctgggtcaaaaaaaaaaaaaaaaaaaaaaaagaaagaaaaggagaggaaggggaggggaagaatagaaggaggagaaaaaggaggaagtggaggaggaggcagcaatattgacaaatgtctactttagcccactactggcttgggaatggggagaagtctgcctttaagcctcctgaaaaaaaaaaaaagcctcctgatccaactttaacctccaaattctcactagatgatcttgcttcttatttcaaaaataggagccattaggcctggaatcccttcacttgttgcctctgtctttaaatgtacctaatcaacattgtcttttcctgtttccctttagctatcttagtagaagagctcttccttctcttgttcaaggctaatttttccatttatattcatgatgtcatccacacttgtcttctccaggacccctcatcattaattaagccttccttcttagttaagattatttattaatattccttttttgtcagacattgctgaatacaggagatataaagatgaatttgatatagctttgaagtatttattatttagtgggaaaaagacagacacaaataattgctgtgcaataatttaatcatgattgtaattatagtagttccttactttatccatggggaatactacaccaagacccccagtggatgcctgaaacaatggatagtactgaaccctatatataccatggtttttcctatacatacatacccatgataaagtttttttgtttttttgttttgtttgttttttgaggcggagtcttgctgtgtcacccaggctggagtgcagtggtgcaatcttggatctccgcccactgcaacctctgcctcccgggttcaagcaattctcctccctcagcctcctgagtagctgggactacaggcatgtgccaccacactcagctaatttttgtatttttagtagacatggggtttcaccatgttggccaggctggtcttgaactcttgacctcaggtgatccacctgcctcagcctcccagggtgctgggattacaggcgtgagccaccacacccggccaataaagtttaatttttaaatgaggcacagcaagagctgaatactaataactaatgataaaatagattagttttaacaatatactgtaataaaagttatgtgactggtctctctctcaaaatatcttattgtactgtactcacccttcttgtgatgaagaagggatggagtggaatgacgtgagatttcatcatactgctcaactgcgtgcaacttaaaacttaagaattgtttatttctggaattttccatttaatatatttggaccacggttgagtgtgctaactgaaactgtggaaagtgaaactgtggacaaagggagactgctgcatttgtgtaatttgtttgatacatgattttctattagaatgtgtcttcagtggccaggcacggtggttcaagcctgtaatcccagcactttgggagccaaggcaggcagatcatgaggtcaggagattgaaactatcccagctaacacggtgaaaccccgtctctactaaaaatacaaaaaaattagctgggcatggttgcaggtgtctatagtcccagctactctggaggctgaggcaggagaatggcgtgaaccctggaggcggagcttgctgtgaccacagattgtgccactgcattctagtctgggcaacagagcgagactccatctcaaaaaaaaaaaaaaatgtgtcttcagtgtctaatacctaagaggtgctcaataaatattattgaatgaatgaagaggggtaagcacagggtactgtggaatcatagaggataggtacttggccctcccctaggagggaaggaagattgggcttatgtcagtggaggcttggtggaggagactgcagcagccagcaggggaaaaaaaatcaggggaaagtaccaggcagagagaggggcatgaacaaaagttgagaatggtgaggaggtggagatggtttgaacagttaggtgttaaatagagttattaacagttaacatctattgagtttacatacatacatagtatatgtttatgtatacttgttaagtactttacatatattttctcatttaatacttacagtattctttgattaaggtattattcccattttagaatagaaaaatctctgcaatacgtagggaaaatagttaacttgcccaagaccatttagcctataaaggatcaaggagggatttgttttggggtctttctggatgcaaaacctggtgctctttataaatgccatgttatactaatacagtgtggttcccaaacttggtggctcatcagagtcccctgaggacctttgtaaaaatacaaattcctggccataccccagacctgttgagtcagagtttccaggggcagagcttatagatctatatttttgggtggttcacatgtaactggcctgggactggttctctcaccctggggagttattgcaggtggtgtcaagagcaaggcaggaatagctgactagccagggaggttttcctgtgtcttgctcctgatccttgactttaccccgtagatggtggggcactgaagctgagaagtgtcatcagatacacatattgtgcccaccactttagcaacagtgtgaaggatgaagttgaaggcacaggttacaggcaataagaacttacatctttagactgctgtcttgactgagttcgtcctttttcctcacattctcaagttttctaaattttttttctcttggttctgccaacccttcagttctcttttccctagctaatttcttgaaagaaatagttatactcaatgttaggtttcagtcagttcaagaaatgttccttactgacttactcttctttgaggtcatcttccatcaataaatgtttattgaatgttatttgaaagcatggtcctttctcagattttgctttgaagtgaaaataccagggatgatttattttttcatcacgtaatcactcatatgacaatttttattgatcaccaagtactcttcatgtgtctcctttatgctagggcctgggatacaacagtgatgagataaggcctcggactttactgatcgaacatctaatggaaggtggaagaagagaccatcacacaatgacggtgttatggggaacacagggtacagtgcattcatacctcctccccatcactgtgtcaatcgcttaaccatctctctgcctccagccttgcttccttccagttaagttatcctcattgattatacatctagccagatactccctactctataaatcttcatttgatagctattgtccttaaaataaaatccaaactccttcaatgtgtcttactaaaaaaacttgagcctatccccaccttgcgtactctcattctgtttcattatagggaagttaaggagcaagaatttgaacttttccttatgtttctttagtttcttttctttctttccaacatgttcttgttctgttgcccgagctgaagtacagtggtgtgatctcggctcactttgacttcccaggctcaagccatcctcctgcctcagtttcctgagtagctgggactacaggtgcacaccagcacgcccagctaatttttgtgtttttttgtagagatagggttttgccatgttgctcaggccttagtttcttttctggaagatttttttttttttttagtattttgaattatttttaagtaagagaaaaaaaaatcaaccttgttaatataaagggtaatcacttaaaaagcacacctaagaattagtatctcaaattgttgtgtagccgccaccaccatccaacttcagaacctttttgtcaccccaaactaaagctctgtgcccattaatcaataacttcacatctccccctcctggaaactaccgttctgctttctgccttaatgagtttgagcactctaggtacttcagataagtggagtcatacaataatttgtcttgtgtctgacttatttcacttagtataatgtcttcaaggttcatctaccctataagaatgtgtcagaatttccttccttttcaaggctaagtaatataccattgtatgtgtatgccgcattttgtttatccatctgttgatggacatttgggctgtttccaccttctgtctattgtgaataatgctactgtgaacactggtgtgtaagtatctgttcgagttcccacttacaatacttttagttatttactcagaagtggaattgctagatcatatggtaatttgatgtgtaactttatgaggaactacgatactggtttccaaagaagatactattattatcaccatgtggcaagtggggagacttgggcacagagaggttaagtaacttgcccaaggtctcacagctagtacatggtaaagccaatggtggctggctccaggtcagtgctcttaaccagcaatatatacatacttactggcctcttttgtaatctctgttataattatgttttcctatttggggaagattgacatcatttggaggttttttttgagatggggttttgctctgttgagcaggctagggtgcagtggtggaattatggcttactgcagccttgacctcctgggctcaagtgatccttccacctcagcctcccaagtggctgggactacaggcatgtgccaccatgcccagctaaatttaaattttagaattttaacttttttgtagagacaggatctcactatgttgcccaggctagtcttgaactcctggcctcaagcaatcctcccccctcagcctcccaaaatgctgggattacaggtgtgaactaccgcctgttttgttttgtttttagaggcagggtctccctatgttgtcaggctagacttgaactcctgggcccaagctattagcttgctgagtagctgggacaataggcatgtgccaccttcgagttttgagaattggactaaatcaaacaatattttactcgtagagtatttccttcttggattgatttttttgtttgtttgtttctgagatggggtcttactgtgtggccctggctagtctcaaactcctgggcttaagtgatcctcctgccttagcctctggagcagctgggactataggtgtgagccatggtacccagctttggattgattttttttttacatgacaaaattgttatagttctcactcttaaatattttttagaatagttctagatgagtatacaggaaactctttaggaatttgtattctacaaaacaaaatgaaaaacaaaagtatactgacacagtgtatcagtaacaaatagcctgactctcaaagtactctcattacaaaacttagaatgatactttttttttttttttaaaggtggtatgttacccagtctcaaactcctgggctcaagtgatcttcccacctcagcctcctgagtagcggggactataggcatgtaccaccacactcagtgaattatatgttttaaaaggatattttgtatattggccatttctctaacatttcccaaaactgcatgcttttggcatctgtgctataaacttagaccaaagtagcttcagaaatacagtagaagctccccttaacgtgtgtgccagattaacataaaacagacatttcctttctaagacatgcttattctaagggcacgcagaataccttttgccattcattaagtatgatgttagttgtgagtttttcataaataccttttatcctgatgaggaagttcacttctattcctagttttcttttaaacaataaccttaagaagtattttttaattgacacataataattgtacatatttatggagcacagtgtgacattttgatatgtacacataatgtgctatgatcaaatcactattcctagttttccgagtgtttttataatgaaaagatgttatgtattgtcaaatacttgttctgtgtctattgagatgacatggtttttttgctcctcttcgttctattaatgtggtgtattatggtgattggttttcatatgttcattctcgggagaaatcccatttggtcatagtggataatcccccataaagtggctggattatgttttcaagtgttttgttgaggattttgcatttatatttataatggatgttggtttgtagttttcttcttatgtctcagttttgttttttttttaaatcatgttaatactggccttatagaatgagttgggcagtgcttccgtctcttcaatttttgggaagattttgtgaaggattggtagattggtattaatttttttttttttagacggagcctcactctgtcacccaggctggagtgtggtggtgtgatctcggctcactgtaacctctgcctcccaggttcaagtttttctcatgcctcagcctcctgagtagctgggattacaggcgcacaccaccacacctggctaatttttgttagagacgggatttcaacgtgttggtcaggctggccttgaactcctggccttgagtgatctgcctgcctcggcctcccaaagtgctgggattacaggcgtgagccactggcacccggccttattgagtttttagtaggtttacaggtactatcagagttattctcaaggtgtttacagtatggaaagtgagacaaataagtaaactgctaattataatatggtttgatagactattatgatagagatagcatgtatgctacatgattacataggagggtacttaacaaaaaagagaagggaagccttcaaaaggtcagttactcttaaacgtgagtgacgaatgggagatagccaggaaggaggagagcaatattccaggcaggagtgtccgtcacaaaggcggagggcaatattccaggcaggagtgtccatcacaaaggcactgggaaaaagcattatcactgggacactacagagacttcctgcctagtgcatctgtgtggaaaagtgtgaagagatcacatttttgagataggtaggagcctaagttcataaagggctttgtgcgcctggttaaggagtctgaatgttagtttgaaaggccttgcgaaccattggaggattttaaaccagacggtcaaattactaaatttgcattttagatcatcctagcaaaatgtggattatggtttgatgggtggaatgggaagtgagagaaaggagactaaaggcaaaaaggcaggaagtgactacattaatttagctggaagtgatgagtgtttatttatttatttatttatttttgagacagagtctcgctctgcctcccagcctggagtgcaatggtgcgatctccacttactgcaacctccacctcccatgttcaagtgatcctcctgcctcagcctgtgattacaggcgcatgccaccacacccagctaatttttttttgtatttttagtagaggtggggttttatcatgttggccaggctggtttcaaactcctgatgtcaagtgatccacccacctaggcctcccaaagtgctgggattgtagtctaatcgtaagcaatgacaatggaaatggaagggaaagaacagagttcagaagggtttataagtagatggccgggtgcactggctcacgcctgtaatcccagcactttgggaggctgagatgtgtggattgcttgagctcagaagtttgagaccagcctgggcagcatggcaaaaacctgtctctactaaaaacacaaaaattagctgggcatggtggcacaggcctgcagtcctagctacttggggagctaaggtgggaggatcgcttgaacccaggaggtggaggttgcagtgatctgggattgcgccagtgaattccagcctgggcaacagagcaagactctgtctcaaaaacaaacaaacaacaacaacaacaacaacaacaaaaaaccccagaaaggttgaaaggtgttgatgatcaaatagaattaggaagatgaatttgttagaatgagaaatttggaggactgtgatcagggaatcagtagaagatagcagtgagaaggaatagtagattatgtgtcctcaagtgatgaaccttaatagagtagtagtttttaatatgaagttgaaacaaggatgctcccagacaagtccaggttgtgggccattctgtatgatgctataaagcctggtctcttcaacaagctaatttcatgtgtgtggggaggggtggggaaggatggaggactgttttagtttcaaagagaacaaaataatatgtaacagccaaatgcagtacataatctttgattggattttagtatgaaaaaaatacctatgagacatttagggacagatggagacatttgaatatggaatagatattagatgatcttagtgaatttttgttaatttttaaagatgtcataatagcattgggattatgcaggagaatgtctttatttttaggagatatgctgaagtatttagggatgaattattctgatgtctgcaattgacttagagacagacagacatggaaagaggaatcaaaaaatggcaaaatattaacaatagtttaggcggtgggtatagagttgcttgtaacactaagctttcaacttttctgtgtgtttgaaaatttccttcattagagaagctggcaaaaaatatggcagattaggagtatggggctatgagtagcaatggggagctctctattgctaaccttccccaagtccctgagataggtaagccacgggagaatgagcagccagttctgaaagggacttcaagatgggtaatgactttggggtagtgcttctcagcttttatcactttaaaacctaaacattggccaggctcagtggctcacgtgtgtaatcccaggactttgagaggccaacgtgggaggattgcttgaggccaggagttcaaaaccagcctggtcagcacagagtgaccttgtctctacaaatgaaaacaaaaattaaaaaaaattagccaggcatggtggtctgtgcctgtagttccagctactcaggtggctgaggcgggaggattgcgtgagcctgggagtttgatgctacagtgagccatggtctcaccacagcacttcagcctgggacagagcacgactctgtctcaaaaacaaagaaacaaacaaaaaccctgagcatggaaaataatatttgtgtggcacacaatatctggtaaaactagatgagctttgggactctacatgaggcttgattattaaaaaaatcattatgttaaaaaattttgttatgtatttcattatgtaaaaaaatttataagaaaataaaacagagcattaggaaattttaaaatgatgacccttttttaaaagttccaaatgtatttaaaatgttaaaggtggaacttgagcttgcttcccaacgtgttactttttaatatcaaactttttgcttgaaatagttgtactcaattcctgattttaaaaaatctttaatatgagctcttcaatttttgatcatttactaccaatgagtaactgttcatgcagaaatgtaaaagcatttttcccaaccattaaaaaatcaaaatatgaactaggcccctacctatctcaaaaatgtgatctcttaacatgttctcacacttttttttttttttttttaaattttcagagcaagatccttcaggctgcagtgcagtggtgctatcatagctcactgcaaccttgaactcctgggcttaagggatcctcccatgtcagcctcccgagtagttgggactataagcatgtgccaccatgcctggctaattgctttttaaaaaattttgtgtgtgtgtgtatgtagaagtgaggtctcgctatgttgcttaggctggccccaaactcctgggctcaagcagtgcccccagcctggcctctcaaagtgctaggattagaggcatgagtcactgcacctggccctcgcacaaatttttgtagtttcccaaggattatgcttttctttttttttttttttttttttttttgagactgagtctcgctctgtcacccgggctggagtgcagtggcaccacctcagctcactgcaacctccacctcccaagttcaagtgattctcctgcctcagcctcctgagtagctgggattacaggctcgcaccaccacgcccggctaatttgtatttttagtagagacaggggtttcaccatgttggtcaggctggtctcgaactcctgaccttgtgatccgcctgcctcggcctcccaaagtgctgggattacaggcataagccactgtgcccggctggattgtgctttttcactgtgcctttgtcagtgatactcctgcctggaatatttcaaaccagttgaaattatatcatctaaaaacttctcctttaattaaccaatataacttggaaaattttctaataatccaaacgatttttttttttttttgagttggagtctcgctctgtcacccaggctggagtgcggtggcacgatctctgctcactgcaagctctgtctcctgggtttacaccattctcctgcctcagcctcccaagtagctgggactacaggcgcccgccatcatgcccggctaattttttgtacatttagtagagatggggtttcaccttgttagccaggatggtctcgatctcctgacctcctgatccaccctcctcggcctcccaaagtgctgggattacaggcgtgagccactgcgcccagccccccaaatgattttttaatccagttgaactgtctcatatcaattatttcaaagtaatgaagatttaatttatatatgatgcatgtgttttttgtttgtttgtttttgagatggagtctctctctgttgcccaggctggagtgcagtggcacaatcttggctcaggctcgctgcaacctctgcctcccaggttcaagtgattctcctgcctcagcttcctaagtagccgggactacaggcgtgcgccaccacgtccagctaattttggtatttttagtagagacagggtttcaccatgttggccaggctggtctcacacttctgacctcaagtgatctggccacctcggcctcccaaagtgctgggattacaagcatgagccaccgctcccgacctctcatgcatgtgtgtttagggccgcacaacaagcttggctgctactgaaaggacatatcagttacggaggcatggaagtagcccatagtatgtgaagataaagatttgggactgcttcctagagccatgagccctgtcagtttgaagtagttgcacactggaatgaacactatgctctttgggcacctggaacagaaacttctccaggagctctctactgggtaatggtgcattctgtatctggcctctgaaggagaagaccacatgatatgtcacacacttggcaatggggagcagtgggtgcctgatggcatttgttgtggttgtcgctgtgcagaacaggaggcctgccatcggagcctgtcgtgccctggtccccctgtgggaagctctggaatagactgctttctggggcctgacttcatctggccacactgagagatgagagataagaggatcagtattttggggtacccctttaatccatccactttacaggctgagtatccctttttctttcttttttttttttttttttgagacggagtctcactctgttgcccaggctggagtgcagtggtgcgatctcggctcactgcaagctctgccttccgggttcacgccattctcctgcctcagcctccccagtagctgggactacaggcacccgccaccacacctgggtaattttttgcatttttagtagagatgaggtttcaccgtgttagccaggatggtctcgatcttctaacctcttgatctgcctgcctcggcctcccaaagtgctgggattacaggtgtgagccaccgcgcccagccttgagtatccctttttcaaaatacttggtaccagaagtattttggatttctaatttttttggattttgaaatctttgcatatacataatgagatatcttgggaaagggattcaagtctaaacacgaaactcatttatgtttcatataaaccctatagacatagcctgaaggtaattttatgtagtattttaaataatttgtagatgaaacaaagtttctctacatagaaccatcagaaagcaaaaatatcactatgtcagccacccatgaggacaagctggttgtttggcatcagcatcattcctgaccctaaattgataggaattgatattgataagcaatcatcttcttacatttattcacacggaagtacttaccagtaaaaaatatgaagtaccattcatgaagtgaaaaaataatgtgttcaaggtaatgaagcagcacagtggcatcaccagaatacctgtgtcagctgttagcaacagcaaacaccggactttcagtctctgcctgcaatgctgtgttttgattagaaggttactgtatactgtacaggttgagtgacccttatctgaaatgcctgggacctccaaatgttttggttttggagcattttggatttagcattttcagattagggatggttaacttgtattgcaatgtccagtgggtaaggattcctgagttagggtagtcctagatttcagttaaggcattaattattcctgatagatgataatttgaaaaaagagactcgatgatcaagtgactttgggaaatgctgtgttgaacaaagttaagtttcatgattgtagaacattccaaagactttaatatactaatacacactataaatgaccatatagaactacatataaatattatatataaaccataatattcagagttttccagacatttttgatcactgaagccttttattgagaagctctggctgggcgcagtggctcatgcctgtaatcccagcactttgggaggtcacgggaggtggatcacgaggtcaggagttcaagagaagcaccttgaggaatgagtgttaaacagaacacagtttagaaaatatattgataagaagttattaaaaattcatgccttgcaggctgtaaatgcactttaatcagagtgccatttgttttgttcaaatgttttaaattattggaatgcacactttttaaaatatgcaaataaagtttggaaactaaaaaataaagttagtgcctgttctttagagatggaaggataaaattataaattataagttttacctatttcaaaacaaaagtcagcattatacttattggtaaaagactagtgttctagattattaataataataattatatttttataaaatggattattatcactttatgcattaatgttgctttggtagtgctggccagtgccatgagtcatgacagagaaataagatacaataagaagataatacaaaaagtattattagaaaatataaaataatcaactgaaagattttaattaatacatttttcaggaaatatataatcaatagcaaaaattcaatttttacctcaaacacttgaaattacagggctcgaaaaaatatttcatcacaatatctacaaaacccataaaatactcaggcatcatcttcttggaggattgtgtgtgacttacatgacgaacctcaaaatatgtaatatttaatttagagatctataagggatatatatatctaaatatacacctcttagatgtgaaaactattctaaaatgttaattctcaatgtatagctgattgcaatagcaataaaactttcaatggtatttcatttggaatttctaaattgtatatggatttctgtatttcctttggaataataaattggtattgatgaacattcctaaaaagaggctaatagagtggcaataaataaaatgctatggtaatggcacaagactagaaatgcaaatcagaatagaattaacagaatggacaattgatagaattaatctcaatcacataaaagatgataatacacgataaagtgcaaggaatcaagcacctggtaaagtaggaaaagctaatctttcactttgaatcacatcaaaataaacttcagatgaattactcagtgtgttgtccagtgtcaaaaacaaaaaacaaagaacaaacaaacaaaccacagtaaatctatctgtaaattgttgaagaaaatagaattaagtatttgccagacctcgagaaaaagggtgatttttctttgtctctctcttgggcctttcaaaggataagtttctcaactttacagtatgagaagaaatctcaacagatgtgactacctaaaaataaaggataatgtacttttaaaatgaccttaaatttaaaaaccaaacatcagctttgtgcagtggcagtgtcgtaaccagagagattttcccaagatactgttatggctaataagaaccttgctagttcaactgtgttcaactcgttgaatttcagtgagataaggcaaatatacaaaggtgaattgggcaggattgttcaataaagaattgattattgattataataatgaaaaatcagaaactaaacatccacaattggagggttgattaaatacattttgataaagctctataatggaatatcaggcagtcactaaaaataataaggtaatgaatatttattgagaatgaaagatccaatttattgctgagtgagaaattagattagagaacaacattaaaagtagttaactctgggccgggcgcagaggctcacacctgtaatcccagcactttgggaggctgaggcagttggatcatttgaggtcaggagtttgagaccagtctgaccaatatggtgaaaccccgtctctactaaaaatacgaaagtgagcttggcggtagtggtgcacacctgtaatcccagctactccagagactgaggcaggaaaatctcttgagcctgggaggtggaggttgtggtgagtcgagatcatgccactgcactccagcctgggcgacatggcaagactccatctcaaaaaaaaaaaaaaaaaagacaaaaaaaaagaaaaaaagaaaagagtagttaactctgggtagaatttgaagtgattttaacttaaactttcatctgtgtctttttcctccagtaattgtgtatgattttgatcatcagaaaggaaatggagctgttttcattttagaaaaacaagttcaaacaactgacctggaaaattgtttgcagtaacttcgacatagggttaagtctttattattcaaacaggtcatgcaaattgtaaagaaataattgaagatcccagtagggttgagcagagaacatgaatagacaattcataacatagaaaacagagatggtaaacaaacatatggatcattattcagattcatttgtaatcaaagcagtgtaaatttaaataatgaggtaatatttatttgttgttaaattagcaaaagtttattgctgtgttataataaagaaaaaataatatcaataaattatggtgtattattttggtaccattaaaaatggaaggttgtgtaaattatgttgcaacctggaaaaatataacatttacgtgaagtaattaaggagttaagattttatactgtaagtactaacaggtgggatggggtggagtgaggtgaggtggggtggggtgtggggggagaagagcaggattgttcaaatgaggaagatctgagttcagtccagctctgccactcaataactctgtgatcttgggcaaggtgcttagcctctctgagctttggtttctttttttctctacggttgtaaaagtatatacagtacctgacgtagaacctggtgtatagtgtttattcagtacatatttgttgagtgagtgaatggtagttattcaatgccatatataaaagaatatgtatgaagaaagattggaagaaaatacagcaaaatgatgagtagttatgttagggggaagagaatttgactgattttaaaatttcctattttctactattgggtggtattatatttctaattgaaataattacctaaactcatgcctaatctctttctttctgggtgtcctactgtatttactgtttgatacattttgacacctttttcttttctttgagacaaggtctggttctgtcgccaggctggcgtgcagtagtgtgatcatggctcactgcagcctcgacctgctgacctcaagcaatcctcctgcctgggcctaccaaactgctataggcatgagctcccatgcttagcacaatttagagacttaattacattattgtcctttattctttcactcagccaaacaccttggagttggccttaacccttttctttctctctgcacctaacataaaatttatcagcaaatcttgttggctctgctctttagaatatatccagaatctgccgggcgcggtggctcacgcctgtaatcccagcactttgggaggctgaggcgggtggataatgaggttaggagatcgagaccatcctggccaacatggtgaaaccttgtctctactaaaaatacaaaaaattagctgggcatggtggtgtgcgcctgtagtcccagctactcaggaggcagaggcaagagaatcgcttgaacccgggaggtggaggttgcagtgagccgagatcaagccactgcactccaacctgggcaacagagagagactctgtctcaaaaaaaaaaaaaaaagaaagaaagaatatatccagaatgctgacatttctcaccaccttcactgctaccattctggcccacatctctcacctggagtattgcagaggcctcctgactggtctctctgcttccacccttttcataatagccaaagtgatcagcagaccgcatcactgtgctgcctggaaaaacccttcagcggcttctcatctcattcagagtaaaagccgaaatccttaaagtagcctacagggctttttttttttttttttttttttttgagatggagttttgttcttgttgcccaggctggagtgcaatggtgcaatggcgcaatctcggctcactgcaacctccgcctcccaggttcaagcaattctcctgcctcagcctcccaacttgctgggattacagttatgcgccaccatgcctggctaattttgtatttttagtagagacagggtttcaccctgttggccaggctggtctcaaactcctgacctcaggtgaaccaccctcctcggcctcccgaagtgctgggaatacaggtgtgagccaccgcacctagccaaggcctctttacaatcaccctcaaactcatacctttctgatcttatttcttactcttctgcacttactgttctctctgcctgaaaactctgcagttgttcataaggctggttccttcccctccttcaggtgtctgcccaagggtcgccttaccacagaggcaggcctctctaagaccaccgtatcaacccattctcccccacccacgcccagcactcctcgtgtccctaccctgtttattccttcctctatttctcacaccatttgccttactatgtattttatcgaatattacgagcttatatttctttcccaataaaagtagctctatggaggcaggaatttttttctattttgttccttgccataaccttagcacattgtaagtactaggtaactgtttactgaatatatatatgagtgtttcatatatgtaagtcatagtccaaaactagtttgaaagctttttgagtaaatgtcatgttggtttttatgcctttcttcccccaactccacaagcaaagaataaggcaaggtaggcagggaacactgttgataagcaaacagtatctgtttttattggtttcactgtgcctctcaggctacgactctacccaaaggacttgagatagagaggccgctgctggaaatattctgtcaccgtgattggagtggttgagtggttccatgagtatatgcgtatgtaaacacttaattaagctgtgtatttaagatcagtgcacctttaccatatgtatattttgcctcagaaaaaatgtttacaaatacagtgtatcctttgacatctccagaggaagttaaacatgctaaatgatacataaatataaggagagggttcttcatatgcttacttattaagattgctagtctggttattagaatttttgttttgaattcaaagctaaagtaaactaatttttatttactttgtcttttgcagagataatagtagcagaatttcacaaaaaaatcaaagaggcatttgaagtctttgaccatgagtcgaataatacagtggatgtgaggtgtggaaatatttttttttttgttacacttttaaattactgatacaagtcataagatacaagagagctattttctctttttacactgtaccttggatttattatgctcttttaagtatttattttccatgctccgtaaaaggtctttgctagctattgctttgataagtactgtttcttattcttcatactctggtagaaacaatatactgtattctcattgcctgttccaacctataattgtaaactctgtgactgagatgaactctattttagctttagtgcttggcacatagttggtactcaggaaatagtcgttgagtgaaggaacagcatttgctttgtaaaacacataaatatgtattataaggccacaaataggatattgcaaggaaacagtaatgcttatgcgatgacacactccccctgtaaaatagcaaaaagaacccaaacagaagaacataaaaaggcaagagaagacatgaatactggtaggtctgaaatggaggacacagcttgggactgaaacaaaacaaacaaaaaaccccttaagagaagagattagacgctaataagaattgtagggtttgtgccacacacatcaaagaaaagcaatgaagccaggcgtggtggctgacacctgtaatccaagtactttgggaggtcaaggtggacagatcacctaaggtcaggagttcaggaccagcctgaccaacatggtgaaactctgtctctactaaaaatacaaaaactagccgggcacgatggcaggcacctgtaatcccagctactttggaggctgaggcagaagaatcacttgtacccgggaggcagaggttgcagtgagctgagatcatgccactgcactccagcctgggcgacagagcgagactctgtctcaaaaaaaaaaaaaaaaaaaaaggcaatgaaaccatcctttcaggaggccgggctaaatgagggttatttgatgagattgcaatctcaagaccagaacctagtagagaggccagcaaagcagtgggaagtggtttgaaaatggttctggaaaggaactgtttgatgcttataaaccagtgccatcagagctgcagcaccatacagctccggtggctgtggtcacattgcattctgtgggaatgacattgtggaacaccaggccttcctgtgggtatcccagtaggaaatgagtgggcagggtgctggtggtggtggtagggttagggagggggtgcagcaggcagcccggcctgcaatttgaataactaactacatgaatgacaagtgccttgacctcagacctctccttgaagggttctcctcctgggggcgggggacagaggtattgttagagaagtcagggaaagtatggcattatgagagagagggaaaagagagaaaagaaaccagcatctgcttgaggcttgtcatctaacacactacgtgtagttgggtgccagaggcttcacgtggattacctcattttaatctttttatttatgggttaagggttggcatctccggtttccagagacaaggagaaggtaaatcgtttgctccatgtcacaccaggtttctctaacgccaagtctcttgctacactgtgggcatgccacactgcccacactcccactcctactctttagagacatcaggggcttctcttctgccttcaggcttcctgacagtagcagtgaaaagaaaatctcccgatcactgacagcaatgatgccaggccttttttggtaaaagggccaattcagtaaaagaaaacgtgtttatgggctgaatctttttttccattgaaagttaaaataactttaccgaggccctgagggaaagtggatgttcttacaacctaaagagtctgctttgttaattaaagatggttactaagaaaattgttattgtttttagcattaaaatattgctgctgagtatatttgaggaataacaacatggatgaatgtagctttataatttttcctgtgttaatttgtatatcactttaaagtttataatgaatgttctcatgctgctggtatcattaccatccactctttttaaaaaattcgtttaaagatagggtcttactctgtcctccaggctagattatagtggcttgatcataactcactgtatgtaaccttgaactcctgaagtgatcctcctgcctcagcctcccaagcagctaggactaccacgcccagctaattattatttcttgtagtgacaggggtgttgctatgttgcccaggctggtcttgaactcctggcctcaagtgatagaccctccttagcctcccaaagtgttggtattacaggtgtgagccactgcactcggccactctttataaattggaaattaagctttgggaggccaaggtgggtggctcacctgaggtcaggaattcaagaccagcctggccaacatggtgaaacctcatctctcctaaaaataaaaactaaaaactaaaaaataaaaataattagctgggcatggtggtgtgcacctgtagtcccagctgcttgggaggctgaggcattagaatctcttgaacccaggaggtggagattgcagtgagctgagattgcaccactgcactccagcctgggcgactaagtgaggctttgtctaaaaataaaaaagaaagaagtgtctttgaacggagggagagatatgtaatggctcagtgggggcaggacagagagagctgttcctggagacgccccccgcccccaggcactggctgttcctcccctaactgctttatccctcaggtggaggtttggtgttacttcctgtgtagggctgatctaggtcccctgagaggtctaggtcttagaattttgtggtggctactttccctttcccttatctctgctttgcacaaattgaaatatttgatttgaaattgtattgcattagataaagggaaagtctggtattccaaatgctgggcagccaccagcccactgtcaaaagcattatgagctgggctcctgctactgcccttccacctctgaggggcagtcctgaggtctggaatcagacttcctgggttcccatcccagctccgtgactgcgagtcactttgttattctctttgtgcctccatgtacctttgcctcctaggtttcatagtataagtaattagttctcagagtgcccccaagaccctttccggggtctgtgaagtcataactattttcataataaatttaagacagtatttgttcttttcattctcactgtttccacaagtatatactggagtttttctttctttttttttttttttttttttttttagacagggtctcgctctgtcacccaggctggagtgcaatggtgcaatctcagctcactgcaacctccgccttccgggttcaagcaattctcctgcatcagcctcccaagtagctgggattacaggtgcccgccaccacgcccggctaattttcgtatttttttttttttttagtagagacggggtttcaccatgttgtccaggctggtcatgaactcctggcctcaggtgatccacccaccttggcctcccaaagtgctgggattacaggcgtgagccaccacacccagccttatactggagtttttcaaaggctacatgacgtgcagttttacaacagattgaacgcagaactagatatgagaatgcagctgtcctctgtgaagccaggtgttacatatttacattgaacgtatgtaaaacaatgtaaaacaatgccattcttctaaatatactttttgttttggaaaatatagtttaaaaaattaacaactatttatgtaaacatttgggttgatttatgatttttaaatgaattaataaatacatatttttaaaatgtaagctttaatttctaatatgatagtaaatatagatgcatataactcacacaaacatagacgctttgagcgccttgataatttttgatagtttgtaaaaggagttatcagaccaaaaagtttgagaaccactattgtgagtggacatttttaaagctcttagaacaatattagcttgggatttaaagctaagaacagtattagctattataattattctactttatatatatatagtttttattattattattttgagatggcatctcactgtgtggctcaagctggattgtagtggcccaatctcggctcattgtaacctctgcctcctgagttcaagcaattctcctgcattggcctcccaagtagctgggattacaggtgcccaccaccacgcccatctaatttttgtatttttagtagagacagggtcttgctatgttgcccaggctgttctcaaactcctggcctcaagtcatccgcctgcctcagcctcccaaagtgctgggattacagacgtgagccactgtgcctggccccattttatgttcttaaagtaaataactcagacttgttttgcccctgtttaatctggatgagcaatgttatgctgtatgtaacaaaactctcataagaactttaaaatacatattttgttttagagacaagctctctttatgttgcccaggctgaccttgaaaccctgagctcaagcgatcctcctgtctcagcctcccgagctgggactataagcacgtaccacacctggctagaactttttacttatttccgtatgttccatatcgatctcttaagatctgaagcattttattttcctttttcatttccttgttaaatagttttcgaaagctagcgccttgaaaaacattgggcaggttttcaatatcactaattagggacattctgattttgcctcatataaaacacagactttttttttttttttccagacagtctcactctattgcccaggcaggagcgcagtggagtgatctcggctcactgcaacctccacctcctgggttcaagcgattctcctgcctcagcctcccaagtaccaggaatagtgagattacaggtgtgtgccaccacccccggctaatttttttttttttccatacttttagtagagacagggttttgccatgatagctaggctggtctcgaattcctggcctcaagtgacccgcccgcctcagcctcccaaagtactggaattacaggcatgagccaccgcacccagccacattttcatttatatatattttcctgctctgtgtttagaagttaagaagactgattgaaaattaaatttttgaatagatgatatatgtacatgggataaaattctaaaggtagaaataatatatagtgataaataaatctcttttttacctatccagttcccctttctaaaggcaaagtttgttacagttttctctaattcttccagagattctccatgcaaatatgtatgagtatgcatgtgcatgtgcgtgtgcgtgtgtgtgtgtgtgcatgtgtgtattttttactgtggtaaaatatagataacctaaaatttatcattttaagtacagaatgcagtggcattaacattactctacaaccatcaccgctatccattttaggctttttcatcttcccaaactgaaactctgtacccatttaacaataattccatatcccaccctctcgcagcctgtggcaaccaccgttctgctttctgtgtctatgagtttcattatcttaggtgcctcatatatcaatggaagagtacaatatttgtccttcctgtgcttgcttgggcagcacatatactaaaattggaacgctacagagattagcatggcccctgcacgaggatgacatgcaaatttgtgaagcattccatttttaaaatacaaacaaacaatatttgtcttgtgtctggtttatttcacgtagcgtaatgttctcagggttcatccatcttgttgcatgcgtcagaattttattccttttttgaataatattccattgtatttatatcccacattttgttcatccatctgtgtattgatggacatttgggttgttttcatcttctgactgttgtgaataatgctgctatgaatactggtgtatagatatctgttccagtctctgcttttaattcttttgggtgcatatccaggagtggaattgctggatcatgtggtagttctgtgtttgatatttgaggaaccactgtactgttttccacagcggctgcgccatgctgcattcccaccagcaatgcccagagattctgttttctccacatctttgccagcacttgtcatttctgttggttttttggaggggggtgttgttgttattgttgtttctctaataaccatcctactgggtgtgaaatggtatctcactggggctttgatttgcattttcctaatgattagtaatattgaacatcttttcatgtacttattggccatttgtacatcttctttggagaagtgtctagtctttgcccatttttaaaccaggttgttttattttgttggtttttgagttgtaggatatgtgtttatttttaacgtgaatggtatgatactatataaaccattctgcactctgctttttttacttatcaatatatcttgactatttattaatatataaaaattggctgggcgcagtggctcaaacctgtaatcccagcactttgggaggccgaggtgggcagatcacctgaggtcaggagttcaagaccaccctggccaacatggtgaaaccccgtctctactaaaaatacaaaaattagccatgcatgatggcgggtgcctgtaatcccagctacttgggaggctgagacaggagaatcgtttgaacccgggagacggtggttgcagtgagccgagattgtgccactgcactccagcctgtgcggctgagcgagactcttatctcaaaaaaaaaaaattatccttatttcattgtatggatgaatcataatatattgaattaatctccttactaatggacgtttaagttgtttccaggcttttgctataatagctcatgctgcagagaatatcttagcatgcatatcatctcacaaaagtgagaactttttctcggtaaattattggaaatatgtcaaagggcttgacaatttttggtagatgttgctatcttgatgatagagtctctcatcttgtgtgagagtaccagtttcttcagtccttctgaaacaagctttaattatcaagcattgggattttttcccaatctaatatgtgaaaaatagaaactcagtgttaattttctttttcttttcttttctttctcttttttttttttttgagacagagtctcgctctgttgcccaggctggagtgcagtggcacgatctcagctcactgcaacctctgcctcctgggttcatgccattctcctgtctcagcctcctgagaagctgggatcacaggcttgtgtccacctggctaatttttgtatttttagtagagatgggggttcaccatattggtcaggctggtctcgaacccctgacctcaggtgatccacccaccttggcctcccaaagtgctgggattacagacgtgagccaccatgtccagcctaattttcattttctaaattagaacatctttcatatctcttaaaactgtttgtatttccttttgtttgacctgacagtttatgatttttccccatttcttcccactgaattattgatctttttctatatgaaaggtctcagccttagtcatgatgtgtctgtcatctatcttttcactctacttttactttctggcatgcagatttttttttttaatttagtcaaattacacacctttggagtatggatttaatttttggaaacaaacgaatgtcatttcgagtagttttagtagaataaatttaggttcccctaaataaagctaatttggtggggacaaaatacacccacaaggagtgcctctaaggtaaagaagataatttttccatgtagctgataaatttaatttgaaaatgactctaatcttattcacaaacaaatccagtttttttgtaatctaatggaataaaagtacaccacaagtccgtagagacagttgctggctctatcatgcattttctatgtgtcaccctctttttatttcattttccttatctataaaattgaaataaaaatgccagcaccacttaagccacaagagtataagaatatcaaataaaaaatatcaacttactttttttaacactccattctaatcaatttcagaacaggttgatactcaagaatttggtgagctaaaatgagatggggcccaatcctggaataaaagtgccaatctttcccctttcccaagccacacccatctgtcctgttcctatgcttcaatgcctttacagtgcgaccttatttttagtattccagactattctgtgtgatatggtttcactgtgtccccacccagatctcatcttgaattgtcgctgccattatccccacatgttgtgggagggacccggtaagaggtaattgaatcataggggcaggtttttcccatgctgttcttgtggtagtgaatcagatgattttataaagggcagctcccctgcagacggtctctttcctgccgccatgtaagatgtgcctctgctcctccttcgccttccaccatgattgtgaggcctccccagccatgtggaactgtgaatccatgaagcctctttttctttataaattacccagtctcgggtatttcttcatagcagtattagtggtatgagaatggactagtacactgtgtttactttatacctgccctatctataggagattttccctaatattttcttaatctttagacaaattttgcagtccagcagcaccaagtatccacttgctaatacagtgagtctcttttttcattgcttccatcttcaactcagtataagtctctgaggctcttggtatccaatatttatttcttttactgatagggagacttcagcttcgttagcaattggcaggaaccttgagtgtactaggtcctgtctaaaattctgtaagaaatagtaacaataacttatttgtaatggattagaaataacttttcctaggagcactggaggtaccataaatattacttttacttcttcacatatagtgctgttttgaagagatattaaaataacatttcgcaattcatgtttatcaggtagtagaaagtgtgagcaatgtggagagattgcatggacagttcccccaagacagttattatctgagaaagctggaagctactcagagagctttataaaaactgttatcgatactgggtctgcatttgtgcaatggaaaaacatggaagaggaatgggaattgctgggtccacacacccctcaataagaaatgaattgtaaaaacaggtttattcatgcagtgattgttcacatgtatgaatgaagtgaatgatgaactaagactacatgtgtaacttggataaatctcaaaaaacaacgttgaatttaaaaaattacaaaaggacggaaacatagtaccatatatatacactttaaatacacaaaataatagtaaatattgtttatgaatacaaatatatgcatggaaatgataaggattatcctcagaatagtggtgtgattgcatctgaagatgaaaggagaagggatgaggagtggaatgttagctgtttctgcaatgctttcttgtcaggaaaaaaattctgaagaaaatgtggcaagatgttaacatctgttaaatcttggtattggctgtcgtattttctcctgtacttttctctgaaatactgtacaactacacataaaaataaatatttttaaaagagtgatttatatcttatctctttaccatctcactttgtagttgctttgttaaaaattggtttcttatcatggtccttttgatgaactgggattaaagaaaagagtcaaagagaattttttaaagtcattccaaattctacttcctgaaataataatttttaatgttagactactattattctagagctctttctatccctgtgtaataaaataagtggatagaagggtgggaaattaatgagaaaggaagaaggaggaaaggaaaggaaggaaaaagatattgaagaaaaaatctaggatataatcttcatgtgggaaggacttactttaattttacttgactgggacaaaagaaaaaaaattaagttgaagaaattgtggaatctcaaatgtttgttagccataagagacgatatttattttaagttcagaaaagattttgagaaaaacattaagagactgtagtccttgtgtgtttttttaaactatctatttcgaatataaaaagtgtcagttgattccttgctgtgaaagataaggacattagcacttccaaaattctgtctacgttttctctcccaacccccaatttatcttaggtatatttttatttttacactgacaaggtagaatgttcatactttgtttagtattcacacatattttagtagttttgtatatttgaatgaaattaccactaaccacattttctcatttttttctccatccttgaattctttgatttatttttgtgtgttgattctcttgtcagtttttttttttttttcaggaagtgctcatggatgtttttgagactgggtctccgtctgtcacccaggcaggaatgcagtggtgccatcacggctaactgcagcctcgacctcctgggctcacacgatcctcctgcctcagcctcctgagtagctgggaccacaggtacacgctaccacacccagctaaattttagtttttgtagagacagggtctccctatgttgcccaggctgggcttgaacttccgggctcaagcaatctgcctgctcagcctcccaaagtgttgggattagaggcgtcagccaccatgctgagcctcttttatcttttacatgttttttttgtgcttgaatactttttacttgaatgacatcttataaatttacacaatcatttctcatggctaagaagtgttccaatgtgtaactatactagaatttaacatatttcctaattttagaaatgtaggttgtttgtaatatgatgctgctgtaattgtgactgggctagaattattagtgtggaacttttcaaagatcttatttctctcctgcactgccaaaaaataaaccctggatgcccaatttattttatctttaccttttcttaaagaggaatattttttttcttgttgggagaagagatatgtcaatcattatagttacgttctgagagtgggatggtgtgcaggataaagaagaaacccactctgaccgagactggaagaggagtttgttaaagatgtgggggaagtaagatttgagagagaggagtggaacttgagcagttacagaatatgaaggagcaatcaggaaaggggattacagcttaaaagtttttgaatagataatatgttcacatgtttaaatccaaagagaataaaattcaaagaaaagtccctgtaactcttttccaccagtcacccagttccctctaaaatattggcaaccagaatactagtttctagggatcactccagattctagccatacacaaggaaatgcaggtatattattttcttataccctgtttttactgaaatggttacttactttcatactatggtatgattcccatggagtggggtcatatctgtgatgaagcttgcttttatggcttttctgtagcgttcggggatctggaatggaggtagctctccagttcaagcttaggctaagtggcataaatgccataagggttaatgtattggaggacatcacaaagggcatggggtcggtcctagatatcccagtaggctatgttccaggctttacagatgggagttaataggaatggcattgtgacaagaaaaataacatttggattcaggcttccctcttcagggcccattactggctgttttaataaagaaggccatttctgtatctttggaggccaactttggttgactgtggattacaggtatctgtctgtttttgtttttgagatggagcctcactctgtcacccaggctggagtgcagtggcctgatctcagctcactgcaacctccacctccccggttcaagcaattctcttgcctcagcctcccaagtagctgggattacaggcacccgccaccatgctcagctaatttttgtgtttttagtagagaaggggtttcactatgttggccaggctggtctggaactcctgacctcaggtcatctgcccatctcagccctcccaaagtgttgggattacaggtgtgagccactgtgcccagccctgtttttttttttggaaaaggaatctcgctctgtcacccggactggagtgcaatgatgtgacctcagctcactgcaaccttcatctcctgggttcaagtgattctcctgcctcagcctcccaagtagctggcattacaggcaggagccaccacgcctggccaatttttgtatttttagtagagatggggtttcaccatgttggccaggctggtctcgaactcctggcctcaagtgatccgcctgcctcagcctcccaaaatgctgggatcacaagcatgagccactgtgcccagcctattgttcttattggactgtcttgatcaagtgcaaattttgctgtatgatttcaaaagtggggagccagaggctgtctgaggattggtggtttcagagagtgtacttcctgaggcctctgggtgtgtaccctctgtggcttccagattcattcgtcctgcagcctcaacctattctccttaacagaggaaatctaatattagattcactcgaaaagtgtggaagacttaatgcaaatgcaccacaaagaacagctcatggtagtttctttattagctttgaaatatagaatggacacaagccagaaagtgttactgtgtattcctgtggccccacacttgtttggaaacggggctcctttttatcattctgttggtcatgctctgtcaggttggatgggaccaaatattctttaagttttctcagttcgagcaagtttcttgtaaggacgtatttggaaataagtataagtgatagaaggtgttataagtaatccagagaggatttaaagtatatggaaggatgtgcttaggttatatgcaaatactatgccatttaatacaaggaattcatttgtataaggaatagcaaaaagtcccctcagcagcattccagcctctcagtgtactggaaggacatttattgccattagggtaacacaggggctctcgtatttcaagtcactctggtgactccacatcacctggtaatctaacatgctggtgattctactcacctgcttttatttcttcttttccagattcttcctattttgctcccgactgatttgatcctgctgtgtgtctcctactcctttgcgtctacctcctcatgggttcagatgctttgtgattctgcacctgccttctctctctgtgccgttcctcttccatctctcttccatctgtatgtcttgctttaaaactcccaaggaaaaaagaagaaaagtcggctttggtcatttgtcaatattcagtagtgtgtgcctttgttgagcagagctcaactgcatcagcccctctcttgcacacctatagagggacgccttattttggttaagtagccatctctggttcaagtatctgtgcctagggaggcaggtccaatggtacaaagcatagcaacctatacattcagaaactctggggagggaagtgtggatttggcagagaccttactgctcatctgatatagttaccccaaatcctaatgaggttgtttgagcctagtgttaggccattccaacacagtttctaggccaacagttggaactctgtggtaaactcaccggtttattaccatccccctccctggtagtgctagtgattcatgtcatggtggtcggctgtggtggagattgcatagtctaattctgtttcctctcctcctgagcacatagctatactgtaattcccagattctcttgcagatagaggggagctgggaattatggtctagctagaccatgtgacctagtttttaccaatgaaatgtggatggaggtaatgggtgctacttctaggcccggtccatggaaacctcccacgtgggaggtgcttttccctttacagcttgatatatacagtatagtgacattggaagccatatgttgaaaattatggaaccacaagatggaaggagctgggtccctgaatgagttgtcggaggaaagccatccaccgatcaggaaaatccattttggattttatgtgagccgtctccatgactattgtgttaagccactggaggctggagtttgttacagcagtggctgttatcctcacatagtggcattattgattttgctccacagggacccaaggaaggctttgggctccttaggtatcttggtgagcactgtcccaggcggaagttggttaacaggatggcccccttcagggagggctgatggggtatgggagagcgaccatcgctttgctactcctgataagcatgacataaagaatgtctctctttaagccttcctccccgaatcccaagctgtggatatcaatacatttgtatagattcatgcgagagttccagagtattctgaaactgcctctgaatttatttgcagaaaggtaggggttagtaactagtgataccactttatgcacagagcaagtaaactccatctttaccatggccaactgtagcaatagagttcagtgttttctatatcacagatagaagaagtaacaaaacttcatccatttcatcttcatatatagtaaggcgaggtgtctgagaggcaggggtgagaaagacaagactggcatgcatggtattgaaatggctgtgaaagggagaagatttgcttatagtagcagggcccaggtagcatgggaattcattacttttatctttaaaggggttagaaacaagtgttcagaggtgccatgcagtaatgaaaccagtccaggagccaggctgtaagtgctgtaattcaagtaagcttttggttaatttaaagggatggtagttacaccagctcctaacccatcgccatcttctgtttcatgtttttgattactgagaagtgacactcaaatgtttattttttcttaaaactactgagtacattttgtaacagctccagtttctactgagagctcatttatgccatatttcctttgctcacataactctaagagtacttctgttttttactgaaagcttgtatttctgtctctgctaagttataaacttactgatgacaaaatgtatttattatttgagttctgtaacgcatacaacattgccttttctctatatacagtgtgataatattagctgggggtatgtaactagttgtgtggtgttattaggaaatgaatctgtaaaggtgggctggggccattcagtgaatgatcttgtctgttgctctaggatcctggatttcattgtgtaagcaatacaaatccataaatgctgagaagggataagatgagatttgggcttttagaaagaaaaccctagccaggtgtggtggtgcacgcctgctgtcccagctacccaggaggctgagacggaagattgcttgagcttgggagttcgagaccagcctgagcaacatttcaggattaaaaaaaaaaaaacaaaaacccaaaaaagaaagcaaactctagctttaggatggtagatccattggcgtgcggaccagagcagtagttcttaatcctgggtgagcttcagagcggcctcacagcacggctagtccggtactgcatgcgaaggagcagcacagagctggcacacggcgggctctccaacccaactggacctggtgacctttatgaacccgcagcccaaagccaggcagaatcaaggaggtctccacaggtgccggtgtgggtagcttatgggccttagccacaccctggcaagtaactatcccttttcataacaaagctttcctgggcacttaccctgccaactgtattctgccgagttctcctctcccggaggcagtgagcatggaatgcccttgtctacgttgggaaaaggatataaaggattatggatgaaataccttctcccacaaacgccttctatataaaacaaaactaaaaaatttccacccactaaaacccctggctaaggccctatgattatctttctctttacagctaagaatcttaaaaaagagtttgctctttattgagcactctgttccttcttcaacgtgcaatttgtaatttcacttctatctctccgtcccatcctgttcaaactgtttttcctgaggttgttgtctcttactttatttttcatatgattgtcttttgttttcttttcttttctctcttcctttcctttcctttctttctttcttttttcttttttttgacagagtctcacttgcccaggctggagtgcagtggcgcaatctcggctcactgtagcctctgcttcctgggttcaagtgattctcctgcctcagcctcccaagtagctggaattacaggcgtgcaccaccatgcccggctaattttttatttttagtagagatggggtttcaccatgttggccaggccggtcttgaattcctgacctcaaatgacccacctgcctcagcctcccaaagtgctgggattacaggcatgagccaccacagccggcatcttttgttttcatccaacacctctgactcttttttctcagcctctgctttgggacgattatctttctatctggactattaatgtctgctagagtttcatctccatccttcttttcatttacaccctttctgggaaatctcttccatacctaaatctgtatcttaacctggaaaacatttttaaagtctatataaaaaaagcccttcttagttcaaaggtaaaattttaggaaaattaaattgaaaacttataagaaaataacaataatggaaactagatttgaaaacagaaatgacaggatgggcgcagtggctcatgcctgtaatcccagcattttgggaggccaaggcaggcgaatcttttgaggtcaggagttcaagaccagcctggccaacatggcgaaaccctgtctctaataaaaataccaaaattagccaggcatggtggcatgcacctgtaatcccatctacttgggaggctgaggcaggagaattgcttgaacctaggaggcagaggttgcagtgagccatcattgtgccattccactccagcctgggtaacagaatgagactccatctcaaaaaaaaaaaaaaaaaaaaaaaaaaagaaaagaaaatggaaatgatgttagaatctatgagatacaaccaaattaagactcattaaatgcctatataaagaaaaatgaaagcatgaagaaaatgaacagaacatccaactcaaaaaagctagggaaaataggtaaactgaaagaaagcagaaaggagaaattaatgaagataaaaacagaattaatggggttgggaaacagtgtaacagtaggaaccaataaatgaaagttttttttttttttttgcaaaagtttaatagaaagataaatcactagcagtgtcttatttgggaaaggacaaatgcaagataacttgggagacagaatgattaaaacataggaaaatttcaaatctaatgagagtcatttgtacaactctatacaagtgaatttgaacacctagctaaaatggtcaactttctagtaaaatacaatttgccagaaccagtcctagtcatatgtatatagattggaagagttaatattgttatgattgcaatactccccaaattgattaacagattcattgcaatctctatcaaaatcctggttgcctttttttttttttaaacaaattgacagttaattctaaaattcatatagaaatgtaagggacctagaatagccaaaacaatcttgaaaaaggataacaaagttggactcccatttcccgatctcaaaatttactgaaaagctacagtaattaagactgtgatactggcatgatgatgtaaggctagacacatgcatcagtggaatagaattgagtctggaaataaacccttacacttatggtcaattgatcttcaataaaggcggcaagacaattcgatagaaaaaagaatagtctttacaacacatgatgctaggatgactgaatatccacatgcaaatgaatgaagttggaccctaccacacaccatatatgaaaattaactcaaaatggataaaagggctgggcacagtggctcacgcctgtaattccagcactttgggaggccaaggcaggcagatcacctgaggtcaggagttcaagaccagcctggccaacgtggtgaaaccccatttctactaaacatacaaaaattagctgggcacggtggtacacacctgtaatcccagctacttgggaggctgaggcaggagaatcgctggaacctggaaggcgggggttgcagtgagccgagatcacaccactgcactccagtctgggcaacagagcgagactctgtctcaaaaaaaaaaaaaaagaagaagaagaagaagataaaagatctcaataaagagctaaaatcgtaagacccttagaagaaaacattgatgtgaatgtttgtgactttggattaggcagtggtttcttagctatgatacctaaaacaagcaacccaagacaaaaatagataaattgaatttcaccaaaattaaaaactttgtgcttcaaaggacactgtcaggaagataaagagacaagccacagagtgggagaaaatatttgcaaatcatatatctgataaggggtctagtacctgtaatatataaaaaactgacaacaataaaaagacaacccaattaaaatgtggacaaagtatttgaatagacatttctccaaggaagattatttaatggccaaaacatcacatgaaaatatgctaagcatcattagtcatcagggaaatgcaaatcaaaaccatagtgaaatactactttagatccactaggatggctgtaattttaaaaatgaaagatagcaaatgttggtggaaatataaaatggtgcagccactttagaaaacagtttagtagttcttgggaaagttaaatgtagagttaccatatgacccagcaaattcattcctaggcgtatactgacgagaaatgaaaaaatatgtccatacaaaaacctgtggatgaatgatcatagtagcattatttatactagccaaaaaatagaaacaactcatgtcaatcaggtgatgaatggataaatgaaacgtgatgtatttataaaatagaatattgttcagctataaaaggaatgaagtactgatgtgtgttacaacgcggatgaacctaggaaacattctgctaagtgaaagaagctggacacagaaggccacatgtgtatgacatttatatgaaatgtctagagcaggcaaatctgtagacacacagatcagtggttgtgaggaggtaaggggagggagggatggacgtagctgctaacaggtatggggattctttatggggtgattaaaatgttctgggattagatggtggtgatggtagctcaaccttgtgaatatactaaagccactggattacacacttaaaaaatcaattgatgaaaaagcaaaacaaactgatctcacaaagatagaaactctaaacacaccaatttacatagaatcattaggcaagttttcagagttctctcaccaaaaggcttcaatccagatagtttcacaggataattctatcaaagaagaacattttagctctagtgctacttcatctctttcagagaatacaaagtaagtataatgttgacaccaaaaacttaaaaaagactgcattaaaaaatcttacaaaacaatcttatgaatatctgtacaaaaattgtagataaaatgttagcaacaaaattcagtggcacacataagcaaatggagtttattccagaaatgtaaaaatagttctgtgttgggaagtttattaatgtaattcatcatataaacagatctgtgaagaaaaatcataggatcatctctatagaggcatttgacagaattcacacattcataattttgaagactcgataaagtagaaattaaggacatgatttcttagcataaaatatgtgtgtttcagcccaaaatctagtttcttacttaataaagaaggcacaaacagcattttcattaatgtcaggaataagataaagatatccgcatttgctgttattatttagtattgactagaggtattaagcaatataattatataggtgataacagacacgtaagtatttgacgttaaatggtagaaggtagaaaagatagaagaaagaactatctttattcacagatatatgattaaatatctggaaacctcaagaaaataaatggaaaaactacaaagaaaaataatatttgctaaagtatagtagggaataaaattaatacatagaaatcaagagcgttcacctatacaaacaatgcccagttggatgatataatggaaaataagactcatttacaatagcaacaaaaaagctaaaatttatagacaaaaatataacaaaaaccatataaatgctacataattcagataacttgaaatatataaaaatagatgaacaaatagacataccatgttgttggataagaggacttgaaattataaagatgccaaataattctaaattaacttattaagttaacacagtctcaattaaaatatcaccagatcttttctggacctagataagtgaattttaattttcatatgagaaataagttagcaagaataggcaagaaaactctgataaagagtaaggtggcccagcgtggtggctcacacctgtaatcccagcactttgggaggccgaggcaagcagatcacgaggtcaggagatcgagaccaccctggctaacatggtgaaaccttgtctctacgaaaaatacaaaaaattagctgggcatggtggcaggcgcctgtagtcccagctactcaggaggctgaggcaggagaaaggcatgaacctgggaggcggagcttgcagtgagctgagaccgtgccactgcactccagcctgggtgacagagtgagactccgtctcaaaaaaaaaagtagggtggtgagtttagctttgtttgatattaaaacatactacaaatcctctattgttaaaacagtatggcataatggatcaatgaaatagaaaatccagaaattgttccaagtgcatatggaaagttaatataggatataaatagcatctctgatgtgtgaggaaaacatagatttaactggatagctatttagaaaaatataaaattgggtctgtacttcatgctgtatagtaagataaagtttgtgtgcaacaagtatctaggtttaaaacaaaaccttgttaagtatttaaaaatatgaatgaattccattataaacttggagtaggaaaaataactcaaaacaaaagccagaagtagaaagattttaaaatttaataaaattttacataataaaatttcaagccaaaaaagaattataaaatcaagagataaataacaccttgagaaaaatcttacattgtaaatggctaatatccctgatattgtgtaaaagtggtaactcttttaaaaatatttgattaaccagaaatttccatttcttgaccacagagaaaaaaggaatctagtatgccattattttgaaatttaatcttttcagtgcacccccttatttactgcattattcacaatagccaatatagggaattaacctaagtgtccaaacgaatgaatggataaggaaaatgtgatatgtttacacagtgaaatactatccagtattttaaaaaacattttattttgaaataattttagagttatataaatgcaaaaacatagtacccaggatgggcaacataatgaaaccttgtctctacaaaaaaaaaaaaaaaaaaaaaaaaaaaaaaaaagccaagtgtggtggcacagtgcttccagctgctcaggaggttgaggtggttggattgcttgaacccaggagctcgaggctgcagtgagctatgatggcatcactgcacttcagagtgcaacagagtgagacgctgcctcttaaaaaaaaaaaaaaagagtttgtgtatccttcaccccattcacatcttacataactacactacaatgatcaaaaccaataaattaacgttggttcagtaccatcaactgaactagagatgtactggagtttcaccaatttcccacgaattccctcctctctcccaggatccgtgcagaacgctgtcctgcgctgttgtcttgtctctttagccctccagtctgtgacagttcctctttcatcaccttgatacttttgaaaaatcctgctgaattcttttttagaatgtccctcagtttgggtttgccagatattttcctgtgattagattgagccagtatatttttggcgagaatactacacacaagtgagtttgtgcccttctcagagcatcatgtcagggaatacatgatgttgctctgctttagtactgatgatgttaaccttaattgcttgcttaagatagtgtctgccaggtttccccacagcaaagttatgaattttccttttgtatttggtaaataccttggaggagatactttaagactgtgcaaatattgattcccctcaaactctggcccacaagtagcatccgttggtcaatcttgcctgtgaatgttattactgtggtttttgccaagcggcgttttggtgttatttttaaaaaggaaattccaggacagtgggcttgttctcattttgttgggcagtcggcagccattgggcaatgtggaatttagaattacttaggcctttcccaacacagaaaaatgccatagtctattaattcagtaaacatttatggaacccttgttatgaccaaggcctcttggtgaaatatgcagacagcataggatctggtctgcacctgagtctttttctctgccactacttttcaccttgaatcacactcgccatcaagatttgttctaagatgttattgcaaaaagtgctgagagacaagtccaggagtcagaggataggaccaatttccaattttgccccagactagctacgttactagcagggcgagtcagatatcgtctcaaagttctagtctccttatttttaaaatagggaatataatatagattgacattagaattaaatgagtggatatatatgaaagtactgtttaagtgaaaggcatttttcaagctataaagtgttctacaaattaattattgtctgggcacggtggctcatgcctgtaatcccagcactttgggaggttgaggcgggaggatcgattgagcccatgagttcaggaccagcctggccaacatagtgaggccctgtctataaaaaacaaacacacaaacatgaattactcaacaaatatttgatttcttattaagtgtgagctttttctaggtgttagaatatagcaatgaaagccaaagcctctgccctccaggaacttatattttagaggaaaaaggtggataatagaaaagtaaacaagtaataaatacaatttcaaatagtaataaatgctacactgtaaataaaacaggatgatgtaacaaaatgtgctataaagaaaataaagtaggataatacattagagaattggggtgtgtttaggtgggatggaatagtttagacgttctggtcagggagtgcgtctctggaagtaattttcgagataagaactttaagattaggagtcagctgtgtgaagcaggggagagcaaatataaaggccctttgaaggggaaaggattaggatgctggagaaaagcaaagaggatagtgtacctgtgaggtcgctagagagtggtgtaagatcaagccaaaaacgttggcagggccaaatgacgtagagcattacatgctgtgaaaaagaagtttctcggtgcagttgatcaggaagaagttgaccagaaagccattgaagggttttaagcagggcattacatgttatgattttcattttaaaaagattgttctggctgctgtgagaatggattgagatggccatcaagagcagaagcagaatgacagcctgtggtctattgcagtggtgcaggcaagagggaatggtggccaggcaagcttggtggtggcagtaagttgtaagatgtcattattgttattgttatgggctgaattacgtcccctccaaattcgtgttttaaagtcttaacctccagtatacctcagaatgaaaccttagttggagataaggtctttaaagaggtgattaagttaaaaagcccaaacaaaagggaggtgattaagttaaaatgaggccattggggtgggccctaatccaatctgacttgtgtcctcctaagaagaggaagtttggacacccagagagacagtgggatgctcgcgcacagaggggtgaccaggtgagggcacagggagaaaaagtggcgcctacaaattgaggaaggccccagaagcagccgacctgctgacacctttatctgggacctctggcctccggaaccgagaaaatcaatttctgtggtttaagtcacacagtctatggtaatttgttatggcagccctagcaaactgatagagctatgacaatcatgggtatggtgctgatctcttcattgtatttatcactacctaaaattcgcttagatttatttatgtttactctttcactcccttgattgtaagttccattacagcagggattttgtctaattcatagtaatcgcaatgctgcggagtgcctgcgccatggcacatgaaaagtgaccgtgtggttaaattgtttctcagtcactctgtaatatccagtattttgtagagcttttgtttttaatgatatacaggagatccagagttttttagggggctacaaactctagcacataggactatataagaaataacactgcagcaagttagaaccaggtgttcaggaagcatatcttagcagtggagacacgatctcttgattagagggaccttggataaaagaggccttttttgaacagaatagctctgctgaagaaagagatttcgtcattattttaccttcatttcatggcttttccaaaataaggtacatgtgtgaaaaatgccctccgtaagggcgaggtctttattttgttctctgctgttctgtaaacgataccagcacatcatagggttcaaatatttgttaaatgaatgaaaacattttcagatcctgctttgtccttagacatttttggattgctttaaatgttctcttatccttagcataatattagctatttaatagagcaggtaaaatgttttgcctatttttttttgtctcttataattgtgtgaaatattctgaatctggtcttcactttggtgtttttgaccttaggctgcccttaaactgaagtcacagcctagctcaatggcactggctcccccttgtgtcaggaacttgatactacacccactaaatgccagcctgccaagaaccaagcttccccgggtcaaacattttaagtggtccaaatgctatacataattaaatgatgacaccacgattgggccaccttattggggctcatttgctccaaatagtcttactcctatgcccactactatatatatagcacaggtacagaaaaacatttttaatacttgtaaccataaaggcttttggagttagtttgtacttcttatcaatataagacatctacgttgacaaaagaaatcgaatgttgactgagtgcggtggctcacgcctgcaataccagcactttgggagacctaggcgggcggatcacttgaagtcaggagtttgagatcagcctggccagcatggtgaaactctgtctctactaaaaacacaaaaaattagctgggcatggtggtgggcacctgtaatcccagctacttgggaggctgaggcaggagaattgcttgaacctgggaagcggaggttgcagtgagccgagattatgccactgcactccagcctgggcgacagagcgagactctgtctcaaaggaaaaaaaaaaagaaagaaagaaaaagaaatcaaatgtctcagcatattttaaatactttatatggaacagttgattttcactttctttcaaaagcctaccaaaattgaggagttagcgtttttttaatcccatgaaatcgatttaaaaggaagaaaattatttttcaaagggacaacattttattttcaagagtagtatttgatttctgttttgtgtacatggtagaatactgagtgagttgctcctggccactctcgctgttgaggagatgaacccgtgcagggacggccccaggaaggcctctttagctgtctgaatgaagtgattttgactctcagcgtcagtggtgtgctggagccagaccgtgccgacttatcccagctcacaagagctaatggctaaatttcaggagttctgcaaactattgttaaagctagtttatattagaaataaattatatagacaattcagttatattaaaaaacaagggtgctttcttcagcagcacttatctaagatcagaacaacatcgagaagatgagcgtggcacctacacaggctggcacacacatttgtgaagcgttccatattttttcaggttattctgtattaaatgcaaaataaatgcttttattaacaatgacaaaaagaaaggtaattgtaataaatacaatttaccacttcgtaattactttattatattttactcatactttgaggttatttgtgtctagtgtatgtgtggtggatgtaccatataatggtatgctattgtcatttcttccagactccacctttagtgatttcatgtttgtaattggcagcttgaaatcgatcttggaacaatggaaataaaaccacaatggaaataaaaaaggatccaaatcaggactttttgcctatgaggagccagtgataaccagcccattactatatgcaaaacgagtttatatgttttttctctactccaaaaacttaacaaaagaaggaattattaaactttaaaaaacgattttaattttattttactacattggtttcagttttttattttattttatcatttatttatttatttttgagacggagtctcactctgtcgcccaggctggatttatttatttatttatttatttatttatttatttactttttttgagacggagtctcgttctgttgcccaggctggagtgcagtggcaccatctcggctctacctcccgggttcaagggattctcctgcctcagcctccttagtaggtgggattacaggcgcctgccaccacgcctggctatttgtgtgtgtgtgtttgtgtatttttagtagagatggcatttcaccatgttggtcaggctggtcttgaactcctgacctcaagtgatccacctacctcggtaccccctcccccgacccagccccaacaaagtgctgggattacaggtgtgagccaccatggctggcttggtttcagttttttaaatagttttttgaaaagataacttcaataatttaaattctttaataattttaataatgttaaaaatggttttaaaaggttgctttaatttaattgaatttatttatgttgagacagagtcttgttctgtcacccaggctgccgtgtgatggcagcatcacagagctcactgcagcttcaacctcacctgctcaagtcatcctcccatctcagcctccagggtagctggaactacagccacacaccaccatgcctggctaattttacatttttttgtagaaacaggttcttactgtattgctcagggtggtcttgaactcctggacacaggtggtcctcccgcctcagccttccacagtgctgggatcacaggtgtgagccaccttgccttgtcactggtcgagggttgtgactgcaagttgtccaggttcttggcattttgaacaaagaattggacaaaatgcccagcaaagcaaagcaaagtatgaagcaacaaaagaacaaaagcagggattcattgaaaatgaaagtacactccacagtgtgggagtgggccagagcagcagctccagggtccagatgcagaatcttcttgggtccaaatacccgctagcagttttccattggccacttcacgtccatctcatgtaaatgaagtgctagcccacagtcagtctgaatggttgcagaaagcagccaaccagaggctgaagtgaagttacaaaggtcacacccctgtgcaaacaggagttggttttcgcagccaatcagaggctagggtgaagttacaaagttatacctctgtgcaaacagacttggcaggccattagtctgactggttgtggacagcagccatcggtctgactggttgtggacagcaaccattcagaggccggagtgaacaaagatgcaaacgaagactcaacccgcagtcagtctggtttgttgcagacagccaatttcccatctgcctaccagaaaaggtagtgagtttgcaaagggagtagcctctggtccttttgttacttaggctggaaagttagggttttcctttcaatttagttctaggaagtcagtgtgaaatagccttaggatccctgcctccagaccctattgccctgcctcagcctggcctaaaagctttacttgaatcttcaatcaattcacttaattcaaagtttcatttagtagaaataggttaaccaaccttaatattatatatgattttatcaattatgttatatttttgtttcattttctagttcctgtctaatgtcttgttttcttatttctaaacttctttcttttattttcatcattaagctatgaatttttttcctatctcctgtaactttcttttcacttatttcagtgtttttacatttttctcttcagctgtctccctttgcagacagacctcgatctctttctcagaattaatggcctcatattttcctgacctgtgctccttctcgctgtctcttttattcttagctcacctttaggatcctcactactcctgaggctgaactgttagcaatacggtttcctccactgtggccaggatcccagctccatccggataccatctggacatgtgcagggctcacctggccccttctgctgttttcccatgtctttggcaccagaaatacgatgcgaggatagtgcataggatcattcggtcatttttgcctctagccccgtatttcagaacatgggaggacaagagaagctctgagtcgtttttgcttctgctgtaatttgtttttattctcatctcaaggaatttggaagtccttttgaaataaatgcatctcatttcattatcatttgaggaaagagacatttgagaggaaagggcgattaatatttaaacaccacctcccttcccctacctcatttgcccttgtatttttttcttctcactcgctctcttatattgcctttactgggcaactatgtcaacaaattgccactgaaaggcacctgactggtgagctgccttgagctgaggtcagtgtgatccttcagctgggagccgctgctccgttttagagggcgagccattgctaccgctgatgagctgagcctggggctcaacgagtccatctgaaaagccatctctcttccagcagcagggagccactcgcagtgctgctttcatcagccttcgtgaaggatgaaaagggcttcgtcttttccacacacacttgactccagcagcgtgggggtttggagcactgatctcccctaccgttgaaaacccacgtgtaacttttgactctcccaaaacacaactaacagcctgctgtggactgaaaaccttactgataacataaatgtcaattaacacatattttatatgttatatggattatctactgtattcttacactaaagtaaactaatgttactttaataagagagaacattaggccaggcgcagtggctcacgcctgtaatcctagcactttgggaggctaaggcaggtggatcacttgaggccaagagttcaagaccagcctggccaacatggtaaaaccccatctccactaaaaatacaaaacttagccaggcgtggtggcgggcgcctgtaattccagctacttaggaggctgaggcaggagaatcgcttgaacctgggaggtggaggttgtagagagctgagatggtgccacggcactccagcctggtcgagagagctagactccatctccaaaaaaaaaaaaaaacgaaaaagaaaatgttattaagaaaatcataaggggctggtgcagtggctcatgcctgcaatcccagcactggcactttggaaggccaaagcaggtggatcacttgaggtcaggagtttgagactagcttggccaacatggtgaaacctcgtctctactaaaaataaaaaaataaacttagtggaacatggtgacacgtacctgtaatctcttatttgagaggctgcggcaggggaatcgcttgaaccccagaggcggaggttgcagtgagctgagatggtgccactgcactccagcctgggtgagagagctggactctgtctcaaaaaaaaaaaaaaaaaaaggaagagaaaatatatttactcctccttaagaggaggtggatcatcataaaggtcttgattatcatcttcacatggaggaggctgaggaggaggaggaggaggaagaggggttggtcttgtttcgagtggcagaggcaggagaaaatccacatctaagtgggcttgtgttgttcacaccatgttgttgaagggtccactgtgcctttcttttacctgcaaggaatggtaggctgatacacagcctcatctcaacttttacttcaggaaacaatattttaggtctatccagggtctccaagtttctgaagtactgagtgaaaatgttgtaactaatatattttgttatgaaactgaggattaagacatccttcataaccagcttctgaagccaaagtgatacagatagtataacaccagagtaaattgttgtataagtagtttatgtatatgaggcagggtttctgttatcctttgttattactgtggttttgatggatgagagtgaaatgtgcttatcttgttttttttttaaataaaatctttttatttaaaaaatttcaaacttctaaacggtaagagtgttgccctgaactcctgcacacttttacttagattcgccaatccctcatgatctgccacatttgtttttgcctcctctttctccttctccctctctcccccgtttctctctatatatgcacaaacacacatacctatttatacattttattattattgttattttcatcatcaccattttgctagactatttgagagtaaactgtaaacattgtaacctttccctgaaatgcttcactgtggatcttctttctttctttctttctttttggagaaaggtgtcttgctatattgtccaggtgggaaatggacatgaactcctgggctcaagtggtcctcccaccccagtttcccaagtagctgggactataggtgtgcaccgctggggtcttcctttctttctttttcttttctttttttttttttttttgagacagagtcccactccatcacccagatgggagtgcagtagctcgatctcgactcacgcaacctccacctcccaggttcaagtgattctcatgcctcagcctctcgagtagctggacttacaggtgtgtaccactacagctggctaatttttgtatttctagtagagacaaagttttgccatgtgggccaggctggtctccaactcctggcctcaagtgatccacccacctcggcctcccagagtgctgggattacaggcatgagccaccgtgcccagcctcagtgtaggtcttctaagacaagaacattctcttacataagccacagtgtctgtgtgtgctcttaaaaataaccttagagtcagatcacttgggttaaggtgtcatttggctcattcctctgcttcttgcaggtgcatttctaaacagtacaaaactgatattttctgggagtgatagaccgaaattcttatgggggccagcctgtgatataaaagtgagaatctgacagagttcatactgtactcatgacatgtatgtatgccccacctaaacaaataaacacgccaatcctagactaaaaaaaaactgtaataagaaaaaatcatcaacaacaacaacaacaaaaatacccgatggccaaatttgtcacttgggtcaacaatttgcggccctggatctacggtcaaagctcccgtggggtggaatatccacagctttctttggaagcactgtggtatagttcagaagttctcctttaagtccaagtgcttgactgagatttgtgagaggcagcagtcgcagtggcaggtagcatgagagctaggctgtgtgtgtgaatcccgtttccaccatttgctaccggtgtgatcttgggaaaatgtcttaacctttctgtggttcacttttcctcatctgtaaaatagtacctttcacacaaagctgtcatgaggaagaagtgaggaagaatatttaaagcaccttacaccagagtctggcacgcgtaataagtcactgtagaactggattctgcgaagacgaacctgatggctagaggccatcacatccatgcagatcatgatcctggtataaggggagagggatgtgaggactgttcctcctggaagacctagagaagatgttcattcttgagccagaaagctacttaatctacttttctcccattgggagtgactttcttttgttcttatccccgttgtcttttttttcttttttcttttccctttttttattagacggattttcgctcttgttagtagagatggggtttcaccatgctggccaggctggtctcgaactcctgacctcaggtgatctgcccaccttggcttcccaaactcctgggataacaggcgtgacccaccgcgcccagccctcatccccgttttctactcatccttcttgtcagacttctccccagctctctcctatatttccctagtgctgagggggtcactgcttgaatattaactctacgtgatccctgacaagttatttaatgtctttgagctttagttttctatctgtaaagtggggacaataatagtacctacctcctagttgttgtgagggttcagtgagttaatgtagggattactgtgtcaggacagtccctggcacacagtaagtgctgtggaactctcagctattgggtaggatgtgcatcattctctttaatagccatattcctccacggtgtactctatacttgtgatctcaattttctttttgctggctcttttttggagttttttcttcctctttttctcctctgcaagtgctcttattgaggtcagtcctcttctttttgtccagatctaagattctgcttattctcttagccttctgaaatattttatttttttactttgagacagggtttcactctgttgcctaggctggagtgcagtgccacgatctcggttcactgcagcctcaacctcctgggctcaagcaatcctcccccaagtagctgggactacaggcatgcgccaccataccccaataatttttaaaaaatttttggtagagatggggacttgccatgttgtccaggccaccttctgtaatactttaaactgtagcaacctggccaggctcatgcctgtaatcccactactttgggaggctgaggtaggaggattgcttgatcccaggagttcaagaccagcctgggcaacatagcaagactctgtctctattaagaaaaaaaaaaaatcagctgggcatgatggtgtgtacttgtagtctcagttgctcggaaggctgaagcaggagaatcgcttgagcccaggagtttgagtatgtagtgagtgtgatcgtgccacttctccagcctgggtaacagagcagaccccatctcctcaatcccccccacccaaaaggaagacaaaaccatcgatattattttgcagccagaagcttgggggtaggggacagtaaggaggttattggagaaagggaagtggagatgaggagggaagggagggagtgggagggagacactggctgattggctgagcagtggagagctaccgatggcaggattctgcagcgcggtgaggcatggggtggatgttgcgaaatgaagctggcggttacaagataagccatttagaagaagtgttgtgattagtgaaaggaagccgggaaatagaatagagtggcgaagcacctatcaagttttttcaagataaggaagatacctgaatattttaaggcaaaagaggaaacagctaataaagaaaataatgaagatgctgagagggagaggtaattgtgtgaagaacaagagctgagtgtggaaacgaaaaactaagagggagatttgcttctttgaggaggagcactttttatttctccaaggctacgagcacgaggcaagagctataggacattcctctaaagtggtacaaagtcagcgactgtaaaggtgacgtgaggattaataatagcacccagtgatcgtgcagttcacatctgttgagtgcagtgggtgataaggacgttttctgagatgaagggagggaagtgggtgataaggacgttttctgagatgaagggagggagtactttggagcttgaggcaagagatgctgcagaatagctgttttgagggagtttgccaggaagtcaacagacgactgagcggattgttaggcaacacccaggacagatttgatgttggatgggggtgaatttgtcataggccacgcttttttattttattatttattgcagcagtgctttgcaggaacaaagaaagtgaaaattgagatgttcaggattatggactaacagcaggcaggatggagggtgaagggcccagagttcagggtggtgacagtggccattttgagtggctgagtgtagaggactgagcagccgtgtgtagattaactgccaagcacagctgcgtgagtgagcctaggccaagctagcggaggaaccacgcagccaacccgcaggatggcggaaaagaataagccgtggttgattccatcactctgtggcgggcagcttgttacacagcagtagaagatgcatgccatgccttgtgttgactgcgcacagcagggagcctgaggcaagggagcctggcacagaagcagaggtcagtcggctggagaagctgggcaggtggagaagaatagagggggcctctggggagcacccagaaatacccagcagctctggagaagtgcaggttttagaatgtgagagtgagaaggaggcttgccatcttgagagatacacacctggtggcaagttgtggtgacggtaagtgctggagggagcgcagccacagctcagactgtctcttttcttccgtgccattcactctcagcagaggaccttgccttgtactacacagaggacagagaagtctttttatgtgagtttcttcatcatcccatttccaaagacaaactagggatacagatatgaattgtatgataaaacttgagataacagataagtcacattacttttctaagtctgattaaatcttgtgcccctacttgtcaagaccaataaaaagttagtagttttcgtggcttctttttggctcttatattgtacagtaagtcttctcttaacctttcaatcagttgttggaaactgcgactttaaatgaaatgatgtacagcaagtctttgaataatgttgttacaaagttgatgagaaaaaaaaatggttttgttatatgtccttttgcttacggttgtagtttccaagaacccatcaatgatactcagagaagacttgctgttctgggactccaaggcttagtgcagtctctgggggaaactggagagaggaaaagcattgtgctcatgagctgtctaggcctgagacagggacagcatccgtgtcgtctgcaccaggctcagccacagggagccttagcacagcttccagggccccagagctcaatggagagattagctttccataagaggaaggaacctcatccagtgcagtagaggaaaagagaagaacataggtgagatataggtgggctagtggagcagtttgtaggtgtacagggagagttcttgaggaagccgtggtattgttcttcaggccactgtggcctcatcagcaaaagaatctttgcctttttttcttatatcatcaggcctttgtgattcgagactagagagaaagaagttgcttaatgcctgcaagatgtcaatcacgtgggctttgttttctggggtctacccgggcaggtgagaccatagcagattcgctcagcagagaagaggatggtgatgggttcctcaaggggatgtgaaagagggagagggaaatttcctatgatagggaagaacttgccattctctcacatgtagcaccttgcaggcggcaggacctaggatgggggtggctggaagaacactgagcgctaagtgcctggccaaggccctcccaccctctcaggaaacccacccacccagtgaacaacgcccgcatcagccttctttgcacgggctctttcccagtagcattaaaatatgctcacatcattcaggtcttcagtatcaaaaaagaaaaaacatcctctttaacaccatgttcctctccagacaccccttccctcccctttacttctgtttgttttttggggtttttgtttgtttgttttttgatgtgggggtctgtgtatgttgcccacgctggagtgccaagtcagtgtctgttcacatcacgatctctgctcactgcaaccttcgcccccacttcctctgggctcaagtgatcctcacgcctcagcctcatgagtagctgggactaccggcatctgtcaccatgcctgacttctccctttcacttcttagatcctccttgacccactgcaatctaatttctcctccaccttcaacggagagtgcccttgtcaaaatcatagctgatctccttttttactaactccagtggctgtttctcagaatttacctccctcgacctctcagcagcatcggaaagccaaggatgactttccattttttttctccttagcctccacgccccggccctctcctggatgttcacttccctctctggctgctctgctccatctctcatgcgggttcctctttcttggatcgttccttgaatgtgggtactcctcagacctcttccttctctttcccagccaatacattctacgtagaggagctcttctgctcctgtggcttcatgaccggatccacgtctccagccagatccttctcctgcacttcgcactcttatgagtatcaagtctgtggtttgattttaccccacttgtaagctagcaagttagcttgttactgtctcatggatgttggcacaagacttgagactcctgagtcagtgacaaaggacttcattcctcttggcacagcaggcaacatgagcatcagcttgtgggtgacagttactcctgccctcaccttttcctggtgatgggcccagctggatgcctgcacaggaaatgggtggcatcacagaaagggaacagagctttcagaacagagaatttcagggaacagaacaggggatatctactgcttttatagcaagcaggaagcaagcctgctctttggcctggagggagacattatgtcatctctcgaggctgctcactgcggcatagccctgagagatggtcagggttttcatggcataaccagcaagaacaagcatgttggaaattcaacatgtcccagattgaactcttcatttcccttcacctaaacttttttacttcctttttaaaaatttatttttatttattttgcacatttattggtatttcttttagagacacgatctcactctgtcacccaggctggagtacaattgcaggatcatagtccactgcagccttgaactcctcggctcaaccgatcctgccatctctgtctcctgagtagctgggactacaggcacgtgccaccacactcgactaatttttaaaattttttgtagacatggcagtcttgctgtgttgcccaggctggtcttgaaatcctggcctcaagtgatcctcccacccacagcctcccagagtgctgggattacagatgtgagccaccgcgcctggcctgtttctccttctattttctgaactcagtgattgatgcagtcctcgatatttgtaactcattaccaactgataagaaattcttaactcttttgactttcctctccctcatgaagtctgatgactccttcgaactctctcttaggtttatttgctcttcttgccgctcgctgcctatccctgggtcagactgtgcttctcttatgtgtttaagacaattacagccttttatcatccagctagaatattcattttatgaagttgtaagttgttttattacgaaatgtttttagagacagggtcttgctgtgctgcccaggtggagtgcagtggccatttacaggtgtgtaatagctcactgcagccttgaacccctggcctccagccgtcctcctgccccagccttcctagtagctgagactaagttacttaatttaaaatgtatgtattcatttgtttgtaattcaaaagattcaaaaggtagatgctgaaaagacttcctccagcctttgcccctgccacctgctctcctccaaggcattctccaccctccagttaatgttaccagctcctcctgtatcctgttaatactgtacccaaggtagacattttatactcaggttactcaagtaccgtatgtgagattgtgacacaaatttccataccttacatttgcttaatacttttttttttgagacagattctcactctgttgcccaggctggagagcagtggtgccatctcagctcactgcaacctccgcctcctgcgttcaagcgattctcctgcctcagcctcctgagtagctgggagtgtcccagagaggaacatggaggcttctgttgctgacacagcacagtggaattctcactttctccttatctgctctcttctcagtctgactccagatggaagctcttccctagaaaagccctgtccagaaggagtttgcatagtctatcattttccattttctgttagccacattttttcaagtaaaaaagaaacaggtgttggaagaaaaactttagacaaggccgggtgtggtggctcacgcctgtaatcccagcactttgggaggctgaggtgggtggatcacgaggtcaagaaatcaagaccatcctggccaacatggtgagaccccatctctactaaaaatacaaaaaattagctgggcgtggcggcccatgcctgtagtcccagctactcaggaggctgaggcaggagaattgcttgaacccgggagatggaggttgcagtgagccgagattgtgccactgcactccagcctggagatagagcaagactccatctcaaaaaaaaaaagaaaaaggaaaactttagacaaattgaatttaacagaatttaattgagcaaagaaccatctgagaatcagctcacccttccaaaaaaagggaagtgatgtacggaaaatggaagtgaggtgcagaaacagctggtgtagttacagctcgaagttggcctcctttgaacaaggtttgaaccgttggctgtgattggccgaaactctgtgattggggcatgagtaggttatgtctgttgtaacatccggttaggttgcagttcactatatatgcggaaacctctaggtcaagcttaaaacatgtaaggaggcagctttaggcgaaacttatataggttggtgcaaaagtaattgcagtttttgcccttttaatggcaaaacccacaattttgcacgagcctaataatttaacacaagtaaaattaattttaacaacgtatcttatttaacccaatgtgtctaaagtgttatcatttcaacatgtaaccaatattaaaaattattaatgagctattttgcattttctttttcatactaagcttttggaatcagtgtgtattttacactgacagtacatttccatttgcagtagtcacatttcaaatgcataatagccagatgtagttggtggctgctgtttggtctagcacgggcctagaatttgtcttttcccaatcttgtctccttcaaaaatctttttttttttttggtaattaaaaagtcgatatatcatggttgtacatatttatgaggtccgtgggctattttgatacctgcatacaatgtgtaatgatcaagtcagggcaattgggatatccatcacctcaaacgtttatctttgtgttgggaacattataattcttctcttcttgctattttgaaaatagaataaattgttcactctaattttcctactgtactatcaaatactggaacttactccttctatctaactaatatatttgttcctattaacccaatatctctttgtcctccttctcctcttcccttcccagcctctggtaaccatcattctactctctacctccctgagaccaacttatttagctccagtaagtgtgagaatgtgcgatttgtgttgccctccttcaaaactcttgcctgcaataagagtgagaatgtgcgattagccgtgcatggtggtgcacatctgtagtcccagctacttgggaggctgaggtgggaggatcacctgagttttgggaagtcaaggctgcagtgagctgagattgcatcactgcactccagcctggacaacaaaagcaagaccctttctaaaaataataataataataataatatctttgctatatgaaagaaaaaaaacaagaaaatgggaaaaaaggaaatatacttgacatgaggatagtacatgttttgttggcccttcatttattaagaaggaagatgagtaagtgaaaagaatcctatattccacagttactgactttaggtttcacttttaagttgatacttattctgcaacctctttcagtgaagaaatttaaaattcttatttaaaacgttttctttgtaaatagggagtaaatataataccactaaaattatccagagtggtaaagaaattaactactctagttaagtgaatatttgcgaaattaaattaacattcaaacattacaactttaattttgataattttgaatggaagtatttcgtaatcaattacacatccctgtcttaatattcagagagtattgaatagcatttatacttttcttaggttatttgtggaattgaactacgttatgatgggggcagggagaggtgaataactcatatttattgagtcgctgctctgccaggagatgtgctttgtattatgatagctcttcttatttaacccttagtgtatcccccttcctggttcttagtgtttgaaggaagtcactgtgttttacctaccaggtaggcttatgcacacattgattaggtaggtgatctctccaatctagtaagtcacagagctgggatttgaaccctagtggtttggcgctagaggccatgcttttaacactctgatactaatgtcaacttcaccacaaaactctgcggtagacattatcatccccattttacaggtgtggaaactgaggctcaaaagagttaagtaacacttaacgtcagttggtacatggccaatgtttctttttctttctagaacttttttatattggcccaggcaaggcatttgccagtcaatgaaaccatttctttcatctttctttggttcacttatcctcctttttctttccccagaaaacatcttttataatcatgaggcaatatcggagtgatttggtttcctacattacaaaatatgctctgagataatttggagaaacctggccttttcggagtttatattctaaaaccattgaaaacttttttttttccagagagattggaacaattatcaggtcattaggatgctgtcctacggaaggagagctgcatgatctgattgcagaggtgagtacggcgaaaaggtttcattcagccagctctctgtgtgagagctactccttgtaattaaaaacaatccttaccggaaactaaaaaaaagtgccccaaactactgaatgtgctcagtggaaatattaggataactattcatattagccaaccaacaaaatctgaaagaattgagcagatcttgaagaaatgactatgaacaagtaacacaactgatcaaataaagaacccactgtagaaatgatcctctctgtaaaattagttgaaaagaggccagtagatgcaaggggctgaccgtatgcagaaaggctattgacagagacagtaaggaatttttatttatttggggaaataaaactaacttttagaacaagtagtaaacagaataaaatatcaagaatgaactttacattgaccagagagtctaagaagtttaaaaacgagtcatgtgtaatagtggaggtgaatgatcccataaggcagtggatgagcagcccacgatgagagtgcttcatgctctgtttgactttccagaaaggtctctgatctcatttcaaatgcagcattcggttcaacaacagagactttaagggaaaaaagctacctggccaggagaagaatcttttcagaattgcttatctaggcacaaagattttagtggagtctggggatggcaaaggggataacaggagacaggtgaggaggtggaattttatctctttattttgcacctagcgcagtacctgcttgttcaacattaagttggagagaaggaattgtgaccgtggtgagtcacttaacccctgttgagtgtcagtttctccataataataactacttcaaagtttgcttcaaagataaatgaaagaaggtacaagaatgcatgttttgaatcctaaagcattatgtaaagttaaggaagggaagattagaaagatgagtctgctgcacagatattagcaccttggtgaccaaaaagcagtagcaattttttgaagcatttggaaatattcagtaaaggaatctaagttgtaagaacacattgtttttaccttttgggattcaataaagctatttttaccaagagtaagaggaaaagcttgtttttcctgaattgatgctcacattaaaaaaagatactgattactgccttaaagtgtttctgcacaaagctggaattagtgttagggaaaagcaagctggaagtgtggaagaggtaagaactagaggacgaatttacagcgaaatcatcatcatcacatgctcaggatagtaagtgaagcaataatgaaaaatacctccgaaggtcagaaaaggaggatctctagagtctagtccctttatggtttgtttgtatgttttaatctctatcaggagttagcaaatcatggcccctggccaaatcctgcccaccgcctgtgcatgtaaataaagtttcactgaaacacagctaaactcatttatttgtatattatctatggttgtttcctgactacaagggcagagttcagtagttgccacagagacctacagcttggaaagcttaagatatttaccatctggcctttgcagaaaaaggttgccaactcctgatctatgggcttctgtgccaaagtagaacaaataccacatctagtactagaagatctgagttcaaactccacagctaccacttatagccatgtggccttcaatgagccacttaatccttcaaagcttcgtttcacatctgcaaaaggagtataataacatgaaaatgtttttatgaggattaaatttaataaccgaggaatcaactgttacttggtgggcatgcagtacatacttgagtttgcttgcactgctggtggctctctaggataataatccccactggtttgggcagttagccacagtgggtgcttaggtcctaaagttttattttatttttacccttttttagggacatgacacaacctttgaaaattacagatatttagaatacttatgtaccagtaggggtcactgagctattaagctctgtaaatatttttctatatttgtatacgaacacaatttactctaattaaattctactgataaacagctttgggtataactaccttttaagaacttttccaaataaatgggtgggaaaaaagcacataaaaaaagcacaaatttgaattgataaatacaagtatgtatttgtacatatttaaatacatttaatagtgaatacatgtaaacacatttagaaaatcaaagccccgtaaaagtcaacatctaggggtaaatgtcatattgctaaatgttctataatagtttcagagatcaaactatttaaatgtatgtgtgtatatgctttaaaattgctctataaggctgggcacagcagctcacgcctgcaatcccagcacttggggaggctgaagcaggtggatcactcgaggtcaggagtttgagaccagcctggccaacatggtgaagtcctgtctctactaaaaatagaaaaaatagctgggtgtggtggtacacacttgtaatcccagctagttgggaggctgagggaggaggatcacttgaacctgggaggcagaggttgcaatgagctgaggtcataccactacactccagcctgcgtgacagagcaagactctgtctcaaaaaaacgaacaaacaaaaaatagtcctataaaaagttgaaacctttgtaaaattctctggttgtcatgtacttgaactttagtgtagacacattcttttctctttaatttttataactttcagccctttgcttcctgaagatcaatttcaaatatggtgtttctcttgaaatagatcattttaaaaatcatttaactttgatccatgcagtttatattctataaatagcaacttcctgcaaatactttctgccttttggaatatcacaaaaactggcaactgtgagaaggattagtgaaaaatcttaccgacatataggctaccaaataatccttcttttaatattaagttagcgccttctaggatcttcagggtatgggagctgggaggagataatggcattttcatacaaatggaaaggttatttagaggtctatgtcttctgaagttccaacctaagtggaattatggagaacttcaactaattacaaaggaaaactaaaagatgatttaaaagtaagacctatgtttgtcagattattgactcaggcttaggcactaagcacggattatgactttttattggggtgaccatctgcatcctccccttccccatccttgcccttttttggttgtagatgttaggcagcacctttgttggctccacatctgttttgctcctaagcgtgctatgttctattaaccatctccacctttccccgtgactccctcttcaatctgtctgctcattatatgaggcctcttaacttctgtgctcaaacaactctgcttggcctctgttacctgggtgtaggagagctggctagcaaatcattacatggatttaacaaacccaggtctacaattacctaatctagtcaaccctggcttgcagaagacaccatcacagaacttagtgacaccagtgcctttctcaccagcctgatacccttggtgagcagtgcatctgagccctcccatggaacagaatcctccagtgagtcttctgactcattagatgcccattctgccctcccacttccgtcagcttggtttgccacttcactcagggtttggtgtcgcttgttccaggtctccacttcactcagggtttggtgtcacttgttccaggtctcaccctcgcagcaagggtgccccatctcctagggtccttgccagagtgttaagtctgtgtcctgagaaagtgcctgaagtcgatgaattcttgcttatccagttttatattccagacctcttggtcaagcactctcatccaatctcaggggtactcccctagctcctagttcaggagccaattcctatctaattccttttgcgattttagtgtatagtctttttctttccttattaggcccagcacttcctcagccagattatgctgggatttaacacttcattattgcctggagcagcccattggatggatggccttggctcaaatatgatggctaggatcatcattcaattacatttcctgcaactgtagatttaagaggtgcatttcattgggaggctgaggtgagaggattgcttgagctcaggaatgaggcacaatggtggcccactgctctgcagcctgggtaacagagccagatctcaactcttttttttgagatggagtctgactctgtcgcccgggctggagtgcagtggcacaatctcggctcactgcaacctctgcctcctggcttcaggtgattctcctgcctcagcctcccgagtagctgggggttacaggcacgcaccaccacacccggctaatttttatatttttagtagagacggggtttcaccatgtcggccaggctggtctcgaactcctgacctcaggtgatccgccctcctcggcctcccaaagtgctgggattacaggcgtgaccaaccacgcccggcccagatctcaacttttttttaaaaaaagagaaagaaaattgaattttcatggctgccatagttgtcgtctggaagagctgtaatgcgaatcaggtgttaagtgtccagtagaatatgaccaaaaggagttggctgctctatatattttatttctaaactcactagggcctacccctggctttcaggattagatcaaagcataaaactacttaggaatgaaatgaaggtcctcatcagatccaaggagtggggcaagagtgagcagaaacttgaccagcacatagtaaagataggtcagtgataagaactgggccaggcttatcctggaattctgttcttggatcaaaagaggataccatggcagggagaccatggtaatgatagttcttaacaaaactgtccctttacatatgatggttgacctcgacatctgtgcacagccatcattctgggatctttgtgatatttctgggagtcactgttttccttctgggttggacttctttctatcccaagttttcctctttctagttcctctagcattttaacatattatttgataacttcttgggaaagagtgccttgggggtaaaatttttgagatttgtatgtttgaaagtgattatgctaatctttggctggaaatagaattctacattcaatggatttttcttcattaaatggatttggatttttcaggtcttcagtaagagttctgaaggcactgctcatcttcatgttcctggtaatgctattgagatagtgcaaatccattctggttcccaatcctttgtatataaacattaattttttttttcctgaaactctggacagttttttttccccagagtttgaaatttcacaaagatttacgttggtgtaaacacatatctaatgtgttaggtacctggtgggccttttcaaactagtgacttgtattttttggttccaggaagttttcttgcaattattttgttttcttttttctgttttttggaactcctattattcatttttgtgtttctggactggactagtctttaacattcttcttttttttttttttttttttttttgtatttttagtagagacagggtttttaccatgtttgccaggctggtcttgaacacctgacctcaaatgatctacctgccttggcctcccaaattacaggcgcatgccatcacgcccggctaatttttgtattttcagtagagatggcatttcaccatgttggccaggctggtcttgaacgcctgacctcaagtgatctgcccgcctcggcctcccaaagtgctcggattataggtatgagccaccgcgcccagcctaatattcttatttttcacttattttccatctctgtctctgtgttctctctggtagatttcttgaactttgtcttccaatatttttattgagtttctcatttctgttgtgttttaaatttccagtagcttgtttttgttctttgaatgttcttttttaaatagcatcctgttcttgtttcagatctctgaagataatagtgttactttatttgaagttttcttctctttgcataatctgttttctccaagttgatacctgtgtctgttctggtctttgtttttgttagtagctttcctcagtgtctgataaaccttggctgtcagttcctaacaaacacatgcatggaacttgtcaactttaaacttcatcactgggtaatctgggaatcacccgcatcggagtgttggggatttttctgtcgtgcaggcttgattctttggaatagagtgttcagtcttctgcttgggaggcaaaagcgtctagctgccagttcggacaccttctgtttacactctttagaaggtaaatctcgaaactcctgcagggatggagggcaggcagtcacttagtggggaaaactgagagggaatttacagcttttcaaacatattttaccctagttcccctaattttagttcctggtccctcatcctcatttccagaagcaaccaatgctttttgaggattctttactcactactgtcttgggttcagttttctagatctactagattattgccactcatccatctacttctcagcttccaaaattttattcccattatattttttcctattcttcctaagtaggtgtatgattattttaacaaatgtttctttactgcaattttaataaggtttgagagagagtaaagttagatgcagatatacagtttgcctccttaacacagaagtttcattgatatttgattagtcagaaaatagcaacagtactcctgagaaaagtattaataatgtaaatctagatgagacattgtaatagtctttagaaagagagcattagtaaatgttgggactaaagcactgataattatagcatataagatgtaatacattggagtgaattaagtatgcatgtgtaaatattaagtgtaactacaaaagagtataaagtgaatgcataacttccaaactgatatagaggataaaagaattagagggcattctgtcagtccaaaaagacagaaaagaagcatagaataatcagagtatctagaaaacataagataatggtacttataatcataataggccaggcatggtggctcacacctgtaatcccagcactttgggaggccgaggtgggcggatcataaggtcaggagactgagaccatcctggctaacatggtgaaaccccatctctactaaaagtagaaaaaattagccgggcttggtggcgggcacctgtagtcccagctactcgggaggctgaggcaggagaatggcgtgaacccgggaggcggagcttgcagtgagccgagattgcgccagtgcactccagcctgggtgacagagtgagactccatctcaaaaagaaaaaaaaatcataataaatgcaactggattaaactcaccagtgacaagaaattgaaattggacttctggaaaaatccgatattataatacatcaacacatttctgccatctctaccttcacattataaatttaactttctcatcatttccacatccatcaccttagtccaagccttgtcatttctccatgaatgactgcaatggcatttatttacttatttacttatttttcagacagagtctcactttgtcgcccaggttggagtgcagtggcatgatctcggctcactgcaacctccacctcccaggttcaagtgattctcttgcctcagccacctgagtagctgggattacaggtgccggccaacatgaccacgcctggcccaatacatgcatttttaaatatttgagatggtattcagtccctactcatttcgctaagtgaggaaacccataaacaaatgttacagttttttttatatctgtggtcagtggtttaatgttacatttatagtgttgagacaactatgatgtcaaagtgtgataaatactccccagtaaccagttaaaataatgtaatgacactagtgaatcatttcctacacttttcatcttggatggaaagtatcatactactccaggcataccacaagccccggaggtcccaaatctccatctttcattattcttaattggttaagtatccttggattttttttctttgaaacttcggaattggcttttgagttagtagaacaagatccacgtaatctacaccctggtgaagtgggaatttctatcagcctgtgcctggactctatcattgagcttctggaagagccctgggactttacatcgtttggaatttgactgtatcaagtttctcagagaatgagaaagggtgggagtaattatgttcttattttgaagtagttggtgatatgaaatgttttatctgttattgttcctacacatcctgcctttgggagatgggggagaatggaattgatctgctctaatttttatttatgttagatgctggaatttaattatagagctgatggtactttgcagattagttagtaatggctaccatccagccattacttcgagtagcatcaggtaaatttggggcaatgaggagaatatattgtaaaaagcatatactgagagtattgcttatttgtaattggtaggaaaacatttaacgatgccaaagccatgatcagcagcgggaaaacgtgacccagggaaatcttcaaaagtggttttttctttattagataaataaaacgtgtttttatatagaacagaaacaatcacggcaatagactaataaatacggttttattccagatttcttattgtataggtaatatccagattacaaaaaattttaaataaataggaacttcctttccaacaatgccatcaccttaatataatcattgttaatattttggtacacttccttacatattatttttctgtgtaggtttttaactggactgtaattttttttgttgctatcgtattcttttttttagagactgggtctcactctgttacccaggctggagtactatggcaagatcatagctcactgcagcctggaactcctggactaaagtggtcctctcatctcagccttccaaatagctggtactacaggtatatgccaccactcccagctaattttttttttttttttagagacggggccttgaaatgttgactaggctggtcttgaactcctggcctcaagtgatcctcccacctcagcctcccaaagtgcagggattacaggtgtgagcatgtgagccaccatacctggcagaactataatcttatagtataattcagtaggtaaaattctgaatcttgcttttttccacctaattatatcacaaattatatctccatgttattacaaagctttcattataaaaatgcatgctgattaaattgcacaagaaaaaaaaggaagggaatgatctctcttctgtgcatcactcagacacaaccagaatattttacctttttcactcactattacatcaaaatgatttttcccttctgttatctagtttttagaaaccaacgctttaagaaagaaatcctgttctactataacatggatgaaacttaaggatattatgctaagcaaaacaagctacagttgacccttaaacaacatgggggttcaaggcaccgacccccgtgcagttgaaaatccaagtataattttgcctcccccaaaacttaaactaatagtctaccattgactggaagccatatcaataacatacacaatcaattaacaaagattttgtatgttatatgtattatttactgaattcttacaataaagtaagccagagtaaagaaaatactattaagaaaatcataaggaagcaaaaatatagttactatccaacaagtggaagtgggtcatcataaaggtctcgtcctcattgtcttcacactgagtaggctggggaggacgaggagaggaggggtttggtcttgctgttccagggtaacagaggcagaagaaaatccatggagaagtggacccatggatttcaaacccatgtttgagggtcacctgtagttataagtattaatgcacaaatactgcatgtgaggtatccaaaatagcccaactcctagaaacagaaaatagagcagtagtggccggggaatggcggaggggaaaggggagctgctgttcaatgagtacagaatttcagttttgcaagatgaagacgttctagagagctgttacacaacaatgtacatgtagttaacactgctgtactgtacacttaaaaatggtgaagatgggctgggcatgggggtgcaccccaatagtttcagctactcgggaggctgaggcttgaggattgcttgaagccaggagttcgggaccagcctgggcaacattgtgagaccctgtctctacaaaaaaatttttaaaaattagccaggcttggtggtgtgtgcctatagtcccagctacttgggaagctgagacaggagggtcacttttgcccaggagttcaaggctgtagtgagctatcgtggcaccaccacactccagcctgggcaacagagtaagaccctgtctctaaataaaaaataaaccaataaagtatacagaaggatgtgcataggttatatgcaaataatgtgccattttatatgaggaagttgagtatttgcagattttggtatccatgaggagtccgggaaccaatccaccatggatacagagggacacctatactaatatcattaatattttccatgccaatattctactataataggagtgcaatcgcttcctaatatttaattatatggcaatgaccatattaataaatagaaacataatattccattaaatgaatattccatattacatatccattcatctattggtaaaggttgctaacaatttttaatatcatggatcctgcatgataaacattatttgaataaagtataggcccttttcagatgccagagggccttgtgaagcaagccaaggcagtgatgggttactgaagggttttaaatgagaataacatgatgagatttgcattttattttattttaattcgtatttgtttttattgaaggaggttgtactttagacaaaccagtctgatggtagtaagcagttagattggaataatttatagtcatcctttccctgggtcatatctgacagcttggagccctttgtacattttgggtaattttttcctaaatggttttatttatctcttttattcagtaaaacttaattgccatgtttctatgatgctgtggtcagaatgtatgtgccccttcaaaattcatatgttggagcttaaaccccaatgagatagtattaagaggtggagtcttcagggggcaattaagtcgagagagtagatccctcacgaacgggattagcaatgttataaaagggctggagagaattagctagtttttgcccttgcatccctctgccatgttaggacacagtgctcatcccctctgggggccacagcattcaaggccccatcttggaagcagagaccaggccttcaccagacaccaaggctgctggtaccctgatctgggacttcccaacctccataactgcaagctgttaggtatgctgtttatacattacccagtctaaggtacttcgtcatagcagcacaattggactaagaccgaaattgatcttcgtgggactatttctataacaaatacctgacaatgtggaagtggctttggaactgggggtcaaggctggaagactttgaggtgtatgctagaaaagcctggattgctgtgaacagagcactaatggtgattctgatgagggctcagagaagagatctgtagagagagcctcaatcttcttagagattatctaagtagacaagaacagaatgttggtagaaatatggatggcaaaggcaattctgttgaggtcacagacataaatgagggatgaggtattggaatccggaagaaaggacgtcgttgctataacatggcaaggaacttgtctgaattgtgtccgtgtccatgctttatggaaggcagaacttagaaataatgaaccttggatattgaaattggcaaagagtttctaaaagtggtaagttcctggcattgacacttttgcacattgctaatagcagtagaaaatggtggtattcatactcccttcctggacggcattttagcaatacttatcaataagctaaaaaaaatatacaagctcattgatcagtttctggaggagatactgtatggagaacaaacagaaagattttacttcaaagatgttagtcacacggttgtttgtaacaacaactggaaacaacctgagtgtccattaacacaaaaatggttcaacaaatcttggtctgtctgtggaatggaatgctgtgcagtcattacaagtatgtcgtgaaagactgatgccaccacacacctatgagagtggataaaatccaaagcaccgacaacaacaaatgctgacaagaaagtggagcagcaggaactctccttcaccattggtgaggacagtgcagcactctcttagaaaacgaaacatcctcttaccacataacccagcactcttctccttttatttatgcaaaggaattgaaaatttatggccacacagaaacctgcacacagatgcttatagcagcttcattcataattggcaaaacttggaagcaaccaagatgtcctttagtgggtgaatggataaataaatgtggtacatccagacaatggaatattattcagcactaaaatgagttatcaagccatgaaaattcattgaagaaaccttttttcttttttcttttttttgagacagggtctcactctgtcacccaggctggagtgccagttctcccacctcagcttcccaagcagctggggttacaggcacatgccatgcccagctaatttttaaaaatttttgtagagatgaggtttcgccatgttgcccaagctgagctcaaactcctggcctcaagtgatccacccaccttgccctcccaaagtgtgggattacaggcatgagccaccacgcctggcctcagaggagtttgagggcagtgaaactactctgtgtgatactatcatggtgaagacttgttgttatgcatttgtccacacccattgaatgtacaacaccaaaagcgatatagtttgaatatttgtccccgcccaaatctcatgttaaaatgtaatcctcggtgtcagagatgggacctggtgggaggcgtttgaatcatgggggaagatccctcaggcatggctcgggccgtcccttggtgataaatgacttcacacaagctctgagttcacacaagctctggtcatttaaaactgcgtggctcctccctccgcactctctcttgctcctgttctggccatgtgatgtgcctgttgcctcttcaccttccaccatgattggaagctccctgaggcctcccaagaaaccaagcagatgtcagcaccatgcttcctgtacagcctgcagaactgtgagccaattcaacctcttttctttataaattacccagtctcaagtgtttatagcaatacaagaacagcctaatacaaagaattaaacctaatgaaaactatgaactttgggtaataaagaggtatcaatgtagctctattaattttttttgtttgtttgtttttgagacagagtctcactctgttgcccaggctggagtgcagtggcatgatcttggttcactgtaacctctgcctcccaggttcaagtgtttcttctgcctcagcctcccgagtagctgggactacaggcatgcaccaccacacccagctaatttttgtagttttagtagaggtgtggtttcaccatgttggccaggctggtctcaaactcctggcctcaggtgatctggccacctcggcctcccaaagtgctgggattacaggcatgagctactgcgcccggccagcttcattaatttttaacacatataccactctcgtggggatgctgattgtaggggaggctgaggatggggagagcaatccaggggacggggcgtggcatatgggaactgtctggacattccacttaattttgctgtgacataaaactactcttaacaaactcaaatttattaattaaaaaaagactaatggcttgataagatgttcacagtgttaagtaaataaaaaaagacgctagaattctatttcttgctaaaatatatatatacatgtatatataatacatacacaaatataatatgtggatatagcattgtattaatgaatataaaactaaaacaaagctctccagcactgtatatacagaagtgatctgtagatgacaggatcgaatccctgcgtgatttgtattctttgtgctcgtctctatttttcactgttccacaaagaacatgtattatctctgtaacaagaaaaagaagaaaagaaaactgcattatatcattcaaaaagttgtctagtggtcacaaagacactattgaagatgcatgttgaaagtttgaataaagttggtttttaaaatgcaaaaataaagagcaatatttttaaattaacgtcgttacatacatgatctgaaacatagctgtggacgtagtaaagtttatatatttaacttgaccaaaactcctttaggggattttcttattagggaaaggagggtcactttttgttcatcagtatattcagatatttattgtgttaaccactgctcctttgcttaatcacaaccaagaataaagcttttcctccaatcatattgcaacacaactttaaatcattgtttttggtctgagtggggttgaagagtatcttagtgagatgattgctgcaacacttgctgcaatcaccatctctatcaaatacaataaaactacttggcgtgggagcggcactcacccttaagtagagaaactggaactggagaggatgaaacaattagtgtagctggtgctcctgaagccccaccctcagaggattaaaacagggaaattaatggtctgacaggcactgctgcagcctttcccccatctcttcaaattggagaaactctcggttggaagtgatcttactaagtaccggatttagccacctgttgattcttagactctctggtgattcatctgtttttaacacttgcacttaaataggaaaggaatttataacccagaagactcgtgcagcctcgtggttgcacagcagcctctggaatctttagaataaataatttttctaaagtaagtggctttaaaatttttgtttttaaagacaacatttttggtagatgccaattaattattgtgattttgttctattcaaggtagagaaatattttctaaattgtgtttatgttttggttttgaaacatagtttatgtcaaaatttgtatctatactatttagagcctaatgtgaactatctcatggtttttatattttttactacaaacagtttttaaacattcacatgtgtatctgatttggtgacctggaactagctgaaatgcagatgctttataaaccatcttaactactgacattatcttgttttttgtgaagcatgaaatggttcagtttattgactgattgttatgtcactggggagaaaggaattttcacggtgtgttttattgtgcctatttagtgggttcagcattaaaataaataatgcttttatgagaaaagagatggcctgatgatttctcgatgcaagtggaagttaagaactccaggctgtgatcccgtcaaaacacctgccggaccctgacgccctcagataggcacttaacctctctgtgcctgtatttcctcaaatccaaaatggattaagaaaattgatttagaccaaagtagagtgagaagcacagtatttgccacatgctttgaggctgagataaatgttgatattattaaaaagtcccacagtatttattgagatggctccatattggggaagaggaggagagagactgtggagtgccggaaggcactgtgttagcctccagaatttgggcccctttgtgtggcaatgaaggcagtatattttcttcaggtcacctactccaccttaattctttgcaggaggagaagccaggcgtatcagggccttggttttccaggtgagcatctgctggcacactgttaagatgaattccctgcgaatggtacttttagcaggctacactcgagggatcttctggcaaagacgtttttcctgtacattcacaaacgctgcccggcttacttttaaattattactccacgttagcccttcccatagaagaaacaaactagacttaacttactttgcctcattcatgtttgcagtaacaagatgtatttgttttgtgagttgcttctgtcttttgaagggagggatgtggagtttggtggatatttgttactctcgcctttttttcagtccaaagaggccatgtggggaaacagcagaggtggaggcatcaccgctaacccacatagcctgccctctagacatggggcgaggcaacaagcggggagggagaaggtgttgaatgcgcctagcaattccgtgcgctatcttatttaattgccacattccacgtggcattttacggataggcggcagaggcaaacttctgtataaacaggtgggtctacactgtgggtcggggaggatgtgcctgaaatttcagcaccagcgattgagtcttttaggaaaaagtgccattgcatgtcatagaaccagaagtgtgtacactgctggtacaaatcatcatcatcatcgtcatgattgactctcagagttcacaaagcaccttcatatctcatggaaccttcacaaccatcctttaggttactggtccccctgttagacatgagcatgctgaagctagaggatgaattttaataacattcttaactattattggtctaacatggggaatatattgtgatttttctctgtaagaaaggtaatgtcttttttatttacttttcatacctagtactgtagaacatctgttttttaaaaaagactctgaccaatacagaaagaagtcaagtggattttcccaacacgactttgctttaagtgaagaaatgcaatgactttgtagtcttttcaaacatgtctgatataatatatggaatctttcttgaattcatttcagtataattgagttttctcctggagaaaataggtcccaattgcaccattttttctgcatttctgcatcaactctgtgaaatacatttttttttttggtttgtttgtgtttttttggagacagaatcttgctctggagtgtagtggtgcgatcttggttcactgcaccctccatctcctgggttcaagagatcctcctgcctcagcctcccgagtagctgggactacaggtgcacaccaccatgtccagctaatttttgtatttttagtagagatggggtttcgccgtgttggccaggatggtctcgatctcctgacctcgtgatccgcccaccttagcctcccaaagtgctgggattacaggcgtgaaatacagttctgaattctgaatatctgctctgcttgatgatagtgattcaaacttgatcagacttctgcttgatgatagtgattcaaagtctttggctaaaaatatgtcatatacacttagaatatatgttagttataatgtttgctagagccgctttgatagtgcaccacacagagtggcttaaacaatagaaatttattgtctcacagttctaaaggctgaaagtttaagatcaaggtatcagcatgattaaacatctaccctattcttcttgttcttttttatgacattggaatataccatatttgaaaaatgcattttagaaaaactaatggaatccaaataaagtttggaatttagtgactaataatatattaatattgattcattagttatgacaagtgtaccataataatgtaagagttaacaatagaggaattgtatcacaaatgaaattacaaattatgttacaaagcaaaagtaatcaaaacagtgtggtactggcacaaaaacagtcatatagactattggaacagaatagaaagcctataaatgaagccatgcataaatggccagctaatcctcagcaagagtgccaagaatacacgatagggaaaggatagtgtcttcaatgaatgatgatgggaaaactgttatttacatggagaagaatgaaattggatccgtatctcacaccatacacagaaatcaactcaagctggattaaagatttaaatgtgagacttggagccataaaactagaagaaaacatagggaaaatgctctttgacattggtctgggcaatgattttttggatatgatactaagagcacaggcaacaaaagcaaaaataaacaagtggcactacatcaaactaaaaagtttctgcatgcaaaagaaacaaggagcaacctatggaatgggagaaaatgttgcaaaccatacatttgacaagggattaatattccaatacatataaggaactcagacaactcaattgcaaaaacaaaaacgacctaattaaaaaaaacggaaaaaaggacctgacattttttcaaaggtgatgtacaaatgtccaacaggtatatgaacatcattgttcatcaaggaaatgcaaaccaaaaccacaatgggatgtcacctcacccctattgtaatggctactatcaaaaagacaaaagtgttggtgagggtgtggagaaaaaggaacctgttggtgggagtgtaaattggcacagccactacggaaaacagtacgggggtttctcaagaaactaaaaatagaattaccatatcatccaacaatcccacttatgggtataagtcccaaaagaaataaaatcagaatctctaagagctatctgtattgccatgtttattgcagcattattcacagtagctaagatatggaaacaacgtgtctataaacaaatgagtggatagtatatgtacacacacacacacgtatgtaatggaatattattcagccttaaaaaaggaggtcctgctatttgcaacaacatggatgaacttggaggacattatgctaagtgaaataagccagacacacagaaagacaaatactgcatgatctctgttacattttcaaaagtcaaactcatggaaacagagagtagatgggtagttaaccgggggtgggggtagaggaaatgggaaaatgttggtcaaagagtacaaacttttagtgataagaaaaacaatttctgatgtacagtgtggtaactatggttaataattattctatacttgaaatttactaagagagtagttctcaagtattctcaccacacatacaaaaaaggtaactagtgagtcggtggataagttaattagcctgtgtggtaatcattccacaaggtatatgtatatcaaaacatcgtgtggcacaccttaaatatatgcaatttttatttgtccatcatacctcagtaagactggaaaaaaatagaggaaactgagtgagagaggtatatgggaactctgtattatatttggaacttttctgtatatctaaaactattctaaaatccaaaggttattcaaatataaaatccttttataatataaaatagtgtctatattaaacattccatgaattctgtacttagaattattgtataattttattgtttttaatgccattgcttatacatgtttttgtactcaagaacaaattggatacggcctctagaggacagtgttgggtcatagaaagattttacaatttctgcccaagttgaagatggtcataatcatttttcttcttcttttctaaccacaagtcctgtttattcgttgtccctctgtaaaaacaacaataacaaagaacacttatgacccctctgctgttctgactagttggctgttttgttttaacttattttcgtataattttggttccacaaacatctattaggcaagaaagatctgcggagttggcaccataatgttcacatccctgagggtttgtgaaagttgtgagggaacccggggaagcgatatgaggcgtatattatgtgtcatttgtgagttcttccacgatggagacggaattatagagttgaacttcctttggaaaaacaaaccacggttcgtagcttgatcagggtgcatgtaagctaaagaggggttttggtcttttaaaggttgagactgcctgctctacagtggtttgttggtggtgggaggaaaggaaaaaaaccattgctcttgcttctggagcaaatttctggagtaatcagaatagcaactcaacattttaattttaaaattcctcctccggagataacctcgtaggattgccattgtatttgcccggggctcctgaggtggggagttgcagagtgctgctcaagtgcgtcagagccatatgaacattcacctgcaaaatgctcgccttggacttagaggcagctgaagacaattgttcatgaatggatgggctcagaaattctgaaacacacaattctgtcattgaatgcgctgaattttctgccgagagtggagtctgagggttctaccttgctaggtgtgaatctagtataaacattaaaaaataggagtcatttggatgatggtgtgttccacttagcagcaacctatagtttttcgtttgtttgtttttgctcgaagaataaatctgtccaaagctcatctgctgaattgggatctttgagccttttaataggagtcttgagagggagtggaaaatgtacagctccttatagatagcccgacatgaaagttaaggtcaatggtgttttgttcagccactccatccaagtcgaacccacgggcagggatctgttttgttctcatttactagtgctaagtgccaaacattctctttctcaggtatagtcttctaatttagtggtggtgtgacaaagttctatttaccatataggtacttaatacgtattatgatgatttaagatgtagttggtccttgagatcgtgattggtcccctcagctggtccctcactcaggattccttatctcagggaaaagcatcaccttatcccagtggtataagtcagaatcttgggagtcatccttgaatcctctgttttttccatccttactcataatgaatgcaggaccaggtcctaccaatttcacttcttaaatattttttgaagccatccatttctctctccatggccgccactccaatctaagcccttgtcatatctgcttagactactgaagaagctgcctcaccctcaagcagtgtgctcttccaaaacatgcatctatgagaccgtcactgatttcccattgttctcaggctagcaaccttatcactgtcatggacaagaaggccctgccgtcgggcccctgtctctctttctagcctcatcttgaagccttctccctgctccttgtactccagcctcctagccgccaatgtgtcagcagagagtcttcgcgtattcagtttcctctaggtgactgtctctcccctgctgtctctgtctcattaccttctactcatactctctaaatcagctggagtgttatttcctcatggatgacttccctggtctcctggtctaagaagtgttctttatttttttatttttattttattttattattttatttattttttatttttttatttatctatatatatatattttttgagacggagtctcgctctgtcacgcaggctggaatgcagtggcctgatctcggctcactgcaagctctgcctcctgggttcacgtgattctcctgcctcagcctcctgagtagctgggactacaggcgcccaccaccatgcctggctaattttttgtagttttagtagagacagggtttcaccgtgttagccaggatggtctccatctgctgacctcgtgatccacccacctcggcctcccaaagttctgggattacaggcgtgagccatcgcacccggcaatttttttattttttatttttttattgagatggagtctcgctctgttgcccatactggagtacagtggtgcgatctcggctcactgcaacctccatctcccgggttcaagtggttctcctgcttcagcctcccgtgtagcttggattacaggtgtgcgccactacgcccatataatttttgtatttttagtagagacggggtttcaccatgttggccaagctgatcttgaactcctgacctcaagtaatctgcctgccttggcctcctcaagtgctgggattacaggcgtgagccaccacgcccggccgagtgttctttattggctgttcttacagacccatgctccttcccctcactgtacttacatcagttcacagtgtctttggttgctgtttcttgattaatgtctgtctccctgatcagagtatcagctgtgctccagttgaatgatgaaggtaaatcttaaaaagataaagtaaaggaccatctctgtgagcaggggtcacgcccaagtgtgctcaccatccagagtctctagcacttggcacagtgcttggaacaactagttgctgaatacatttgttgaatgactaaatggctatttacttattgaatgtttaggtagaggaagaagaacccactggatacattcgattcgaaaaatttcttccggtgatgacagaaatactactagaaagaaagtaagtaagtaaatgcaattgttaaggcaaagtaatggtcagaattatgaatccattcatttcaggacgcttggctttttcactttgtgtgttatactcaagcagtgtgtcctaaggtggcctccctctaacctttcaagctacttctgaactggcagttggtacctgcttagaaatatcaaccacactagtgttatcctaagcaaagcataattagagggtaaataagctataaagatcgtaaatcaacattcttagtatcttctgttttgaattatcaatgataaataagaatcctaatatttttctagcaaaaatatagcattagcttaccatagttggttcatcatagaagtcttgtgcccagataaattgatgtccaaaaagctaatagataacctcaaacatgtcagtgattttgcactaaatatttcctgtggggctgaggtattttcaactttcatatccagaaatccaaaaagatttcaatgaggcaagtattatcatcccagtatgttagcagcttttattttattttattttattttattttatttttgagatggactttcgcttttgtcacccaggctggaatgcagtggcaccatcttggctcactgcaacctccacctcctgggttcaagcaattctcctgcctcagcctcccgagtagctgggattacaggcacgtgcatgccaccatgcctggctaatttttgtatttttagtagagacagagtttcactatgttggccaggctggtctcgaactcctgacctcagatgatctgcccacctcagcctcccaaagtgctgggattacaggcatgagccaccatacccagccctattttgttttatgtggtcatttattacggggatccccaaccaccaggccaggtactggtgccagtccctggcctgttaggacccctgggccacacagcaggaggtgagcagcaagagagtgagcattactgcccgaactccgcctcctgtctgagaagcattggcattagattatcataggaatgcgaaccctattgtgaactgtgcgtgttagggatctaagttgcatgctccttatgagaatctaatgcctgatgatctgaggtggagcagtttcatccccaaaccatccctcccctcccctggtctgtggaagaattgtcttccatgaaactggtccctggtgccaaaagggttggagactgctgatttattatgtaaagactgcggtaaataccacggcatttactcattttattgcataattatagatacagaccaattccagaagatgtccttcttcgagcttttgaggtatgtaaactccagcttatatgcatatacatatatataaatacatttatttacatacacacatatatgaaaaatttatcatgtagaacttattcaccaaatgaaaaatataatatctatcttttcttttcccctaggttttagattcagctaaacgtgggtttcttactaaggacgagctgatcaagtatatgactgaagaaggtaagtgtgatttattacttatcacaatgacttatgtgaggaattaataatttgttaacagttatgcgaaagttataggggatactttaaaatcagtcattctggtgaaagttatttactgttcctgctattttggcttggggatggtttctgttctgtgggggttaagaggacaaagagtagggaaaggggagatgggttgttgtctcgtagaattttgtgaagcacagtgattacttctataatttcaggcattgcattcagagcatttccagaataaaagatatgccatctggaaaacatgaactatcgatcactgtaaatgaaggcctcttcctagattgaagatttgaataaagaatataaaaattccgccccccccccggcgccccggcttttttttttttgagacggatccggtcttgctctgtcacccaggctggagtgcagtggcgcgatcttagctcactgcaacctccgcctcctgggttcaagtgattctcctgcctcagcctcccgagtagctgggattacaggcacaggccactgcgcccagctaattttttgtatttttagtagagatgggtttcaccatgttggccaggctggtctcgaacttctgacctcaggtgatccacccatcttggcttcccacagtgctggtaaaaattcccttttaaagagcttttctgtcagtgaagttacagataatgtagcctcaattgaatactgaggtcatttttaacactaaaaatgtccttttttaatgttaattgaaccatatatatttgttttgaacatggcccatcatacatatatgcatacacacacataaaacctgcacacttatatatatatgccaacatatttcctttaggaattctctctgctaggctgatgtgtaaatttgtttacactgaaggtcagtagcctgatggacagtctcctgaaaccatcctcatattggtccccttgccttctcccatacaaagctagagctctctggttcacagactgggtcctgaatgactcagagttgctaatcacttgaggcagaatgaaaagcgcaagtgattttgagtagggaagactaagactgcatctacacgcacaactggtttgaccattccagcttcatccaccttaaggcggaatacagagagtgagggtcagaatggcaaggccgtcacagctgccacccaagaactctgacgccattgttaaaattaccttcgggattaattctgatggggatgttacgactttcaaagcatcagcttcttcatcctgaggattagtctaaagaaagtaaatcctaggttatatatcaggcaacatgaatttagtcaaaatggcccaaacagttagattttcctactgttgtgtgcctactatatgtttaatatttagtaagtgtagtaaggtataatgatacttaaatctacttcctctctcaaggatattacaatcttatttgggaaataaaactaacataaaataattcacaatacaagacaatagaaagctaaatatcagaagatcaactagggctggcccagcctggaaaacttggtttgggaagacttaaagagaaaataggttttttgagatggtagaatgtatatggttaaattgttgagggcaaaggtaaactcttgtgcattataattctgtcacacatggtagatatcaacaaatgtttgttgaatgaatgagtgaatgagtagatgatgaagaccaggtgaaggggctaatgagagggagacattatcgatgtgtaaaacagtctgaacaaaaatggggaggtaggaatgaacatgctatttcagagagaaaataagcctagctggcccagagggtaatgttggcaaacagcaggaaattaacttcagtagacttactgggactaaattgtggagtcccaggctcaggagtttggaattcatcctgtgggcgatggagaagtattacaggcttttgagcagatgactcacatggtgtgtgagtgattgtgagaaggtttttctggtgctggtcggtttgttagatgcataagaaagaggttggactagggaggccacttagaaggttatttcagcattttgagggcacccaaataagggcctgacctggcagtgggaatggcaatgggaagaagggattggtacaataggactgtctgtggcaggatccatgggtcatgatgagtaacagagtgtaggcgacaaagctgagagctgaatccaaagtaccaccaaggctttgccctcgatggcgagtatgatggtaatgagactgactcaaacagaaaggtcagaacagaccgcagtgtatacagagacagtgcgaccacgtggtttacttggaggtgctgtgtgataatttcgaaaatggtatgtttacagagagttcatggtacttaaagatcaactattgagtatctcagcggactaagcataggacaggtatggtcaaataagaatacatatgttttcaattattcactcagcaagtattattacaaaccttccacatatatgaaccaatatgtttggaagtaatatgtaagatgtaaatctatacaaatctaagttacgatttaatataacagacccatcagctaagtgtaatagcagttgactagtttggtaaaataggagcttaagaattgctgctttgagagtctcagaattctacaaattgtttttaagtacatttatgctatataacaatatggattcaagctacttgcacattcatcctaatatccacaaagtatcaaacacactagtttgagaatatgcattcctacagccctggatgtcatatgataaaataaatcacactgaatcaagttcctacaagatagaagtccctaagtgtccaggaatgtgtattgcatcagacagtgtttagcagccgggaagatctcagaacaattttttaaacaaacacttgcatgttgctgcttctatgccaggtactgttctaagtcccattcaaatcataacacgtttcattctcatgacaaccctatgtgacaggtggtgtcgttatcacccccattctagagacaggtaagctaaggtggggagctgtgaagtgacttgctcaagatctcagagctcgtgagaggcagccagcatgtggatccaaacttgtgctttaaccactcagttatcttccttccatctttcatcaaatactggggcttcaagttaatcctctggtaatttcaaaagttttaatctaaataaataaccttgttcatgatgtctgtatgtcttcctactgttttgcctgaaatgacgtgttctagaggttgcttgatctatgacatctgcaggctaaaagaagtccagaatctaccagggtgtacaatagccttgtctttgaacctctggactgtcgtgatgtcctggctctacagctccagggagcgtaactagtggcactgtgggagcttgtggggctccatggctattaagctggctagtggaaagagaaaaaaatcagatgatcctaaatgataaattttcctttttgtctctctgaggtgagcctttttctcaagaggaaatggaagaaatgttgtctgctgcaattgatccagaatcaaattcaattaattacaaggactatataacaatgatggtgatagatgaaaattaaatgttctaaagataatttctgattgaaagaacaattttagaaattgcttgttcttgttaatttcacatcttatcttaggattcctatatgtgatatttaataccttgtgacataactattttaagacactttgtttttaaagatgatcgtaacactttaaaccaaatttagtatgtctagccttacagaatgataaattactatttatttaaaaactattcttaaaacattttaacattagaatggattgttgtttattttctacaataaaactcaggtcaccttcgaattaattaagctgacaaaatgaaaatgacttaattacccaaggtttggcatgtaaagatcttaagagggggcagaacgaaccactcgaaaacgagtagcagtgtaatgaaggcttcttttttaaacaataacaaatgcttcatcaatctgagtgtggaaggtgatttatcaaaataaatattactaatttatttttttatgagtgccaattacaaatatcatttgggataataataacttagtgtaaacatttatatttgctgatccagcatgtcaccatttatggagtagctaaaggagttgagatcattggaactagagaaaagaaggttgagtggaagttgatagtgtaaggtagtggcaattctccctttgtctttagaattctcacccactccgcatatctgtcatgggagcattgtcctgaatactgagtaagaatactgagaaatgttatggtgtgcaaatgtacagctcctgaaagagcagaatgaagcacaagcagtcacaatggaaaaatatatggcatggccactgcctcctccttgcaattctctccgatcttggcatcttatatggcaactatatggcaacttacaagcaaaggggaagataaagtaaagggaagtgaacaattttccaaacttagatattctgttataacaagacacacacacacacacacacacacacacacacacgggtctctatttgaagatggcttcaccactatatgtgtgtatctacatagatgtaaacatttagagttgctgtgagccttcctcaggcatgtagtcttgcccccaaaagaggcggctgctacccaagagactgtcgctgttcattcattcatgaaacactgaaggagtaccatgagatgatgtgctgggaaccggagtccctaacgaatccaggtcacagtttagtgagggaagcctgcaaggcagtcagcagccacatttcagataggggcatgttcagggtcccgtgcaagtgccgaagagaggcagctactcagccttgcagggagagagctttctggaagatgaaaggtgctagtgagcggagaaggcttcccaggacaggaagctcctgactttaaaacgagtagtttagtaagtgggtggcggggcacagggcatttcagcaggtgagcagcaagtccagaaaccctagaggtgtcatgaaacatggaaccacctgggaattgaaagcagctcagtatatttggaatgtgggagatttgggggtcatgatgagaggtgaaattggagtggtaaacaggagcggtatcattaaggatatcgggttaggtgctgagttaaggtttcagtgtgagagtttggactttattctgaagatcacagagaaagatcatttgtaagcagcatggaaaatagatttgaaaggtcaagactagaagtgagaccagtttgtaggctatttggttggtgggaggggatagactgggaaaagtcaagcatgaatcccaggtttctggctcggacgatgggtaaaagtgccattcattcagataagaagtccaaggagcaagtggggcatttggtaagcaaaatgatgaggttgggtgcagacaccttgggacacccaaagggtgacattcaataatcaattggatataggagggagatctggctggagacctggattttggaactgtcagcatgtaagtagtattaatgccttgaaagtagaagagaagacagtctagaacaaaaccatgggggatatcagcatttacgggaaggcagaggaagaagagcccacaaaagagactgggaaggagaagcctgagaagagggaaagctggaaagaagcatcttggatgccaagatcggagagaattgcaaggaggaggcagtggccatgccagatgtagtggagaggagagggaagttaaagacggaaaaaacgtccattggtgttagcaatggagagttcattgagggcctctcccacagcagatgtggggaagcaacagggtatggagttgagtggatggagtaaggaatggatgtgagaaggttgcagcctggaggacaagttattcggcagtgaagaggaggaaacggacaacaggctcggggagtgatttttggaagatgggtggatgtagcaagttcatttctagtccaagggctgagagcccacagagaaggtgaagggaggggccagcttccagagcaataaagagatttaggaacaatgaaccaacgcttgtggtccctacctcatggcctctgctgccttttggagaggaaggtagtaggttatagagtttcaagagaatggtgtaattttggaatatctcttgtgggaaatgggagaaagagttgagaaagagcccatgtaaggattttcaagaaaccctggaagattttgtgctcaggagcaaaaaagaaaagaaaaaggtagattgttgtaccagggttaaggttttgtcatgtgcgtgaggtggaaggaatcaaaggccgaggaatctgggagaaagcagttccgatggtgtccgtggggctaacgcatgagggaaagacccaggtaggaggagtgggtaacaggtaggaggagtgggtgacagatgggagggggtgagagggctcggggccctaaaagggcaagtggctggtgttggtagcaaggggtggtctttcctgcctgagtgataattcctgagtgataatatgtttcccttgaaatttcgcttcgatgtgttcttagagtgtttcttttcttctcctgtgttattatgtgaataaatagtaagagtggctgacgtttgttgactgttccctgcgttgcaggcactgtcctaagtgcttgacgtacatgaactcatttcatcctcacatccacccatcggtgcaggtgctattaagttatccccattttagaaaggtgacaatcaagaagttacacagcagtaagtggctgtatcagctttttctaggttatattgtgataacaaaactcccacgtgtcagaggtttgcaagaatgaagcttatttctgtttacgttttttttttttggtcagctggggtcatcctggactctggcctacgtgtctttgtcctactcatggcctagagaggtaggatgaccgtctgtcctgctttgcccgtggtagttccagactatacctgtcccagtgtaattattaataggtctcctttgtactcttagaaatgttccagtttagatgattaatatgtggtcatcccattcaaaaaatagtgagtaaaaacggtggtgaggaatcgtcacttctggaaggcttcctgacagataattccagcagtggtaagaatggaaggcatttcttccttctctagtttcccaagatcatttttttccccaggataacctgagattttcccaaggtaaaatccaaatagagacctgatgtgccactggctcggccgtgcatgctagaatcaccagccagagatgaggatgaaccgcgtgccttcaggacagggcggagacggaggaggaaaggagtgtggtgatcctcggaacatcagcagacaggctgttgatgataggaacacattgcagcggggaaggaggatggctgagatatgaaatacccttcaaggtggacgcatacccaggggcatgtcattcggtggcaggggccagcacggacatgcagcactgaggcgtgtgctagcgcccagtgcgtcgacccaggcacggacttgtttggagcatacaggacagctctgcgttaagacctgtaagccattaaagaagtacagtctggtgaatgaaccctaatctcttgatgatcaagtgatgacatcatattctgtctccgaggagacaccctcttgcacagaaggcagtagaggaagcttgcgtcgagattgcctacctccccagccccaccttcgagggttctttcaaaagttcggactgatgttcaacttcacatcttgtctcaaggcaatcctctctgtttagtctcatagagttggctttgtggaatgtaattcatttttatctttagcacaaatttgtctgtttcttttaaggccaccagaaagcacaacatagactccccacagaaatctcattttatctcctaagttgcagaataaacgtaccttgtttgcaaagggaacattttcctttacactcaaatcacttcaatgtgtattttgcctcttcagctcactgacctcgcccgcagcatctgatgtaagtcaccatatgccatttcccgactaggagagtgcttggcctcttgtgcaggaagtttgcttaccctcatgactcctggcttccgcagagcctgccataccccacagcttggccgggccctgtggaaagccatctctattctcacactgctggggaaggtgcatgactcaggacccgacacacaggcctgagagtctggcgatcttgtgctctgatcccagcttcatgtgtgactcactctggatcaggcgcttcacttcctgtgcacctctgtctgtaaaatagagagcccagctctagtccttctccctcctgagaagcaatgcagagatttagtcccctttgcagtcacccagtgtctaagtaccaaatgcccaagagacaaaaaagagtccaagatagcaggctagttgggattacgactgttcgttaagggcaggagtattttctgtgggatggaatgtgtttagatctctctctcctagtttcctgtcttccttcctttcgcttttctaaatccttccatgtaagaaagtaccctgtttatacagacagttccttgaagatcagtgtcactaccttaccctcctgggctgcttaaataaacggagagcctcatgggtgccaggcatggtggctgcctcctaggcctgcctatttctgaaagcatggttgccaatcatctgcttcaggagcatctggaaggagggtgttagaaatgggaggtgtgccccattccagacccctgaaacagaatctctggaggtagggtccaggaaacttatatttttaatattctcaggggatccttatgcacgcttgtgtgtaaaaagcactacctggggctctgatattgaatgaaagtgtgggatttggagttaggctctgctgcttactgattacgtaattggcccagacatttaatattgctgagcttccccggaggtcgaggctacagtgagccatgattgtaccactgcactcagcctgggtgacagagagagaccttgtctcaaaaaaataaaaaaatattgctgagcttctgcatcttaatttgtaaagtggaaaaaacacttttcggggctggtgtgaaaattaaatgaaataataaaagtgaaaatgtttaaaaagctgtaagctatgacacaaataattatttacagaaagccagctaggcagagagggagagagaaaaagagagagggaggggcagggatggagatctgctgcctgggtgtggacagggaggtggggaagtaggtaaataatagaaaactaattggagagaacgtgcgcatacctgggctgctggtggggagatagccgaggtttgctgtcatggtgctattaattataaggcgttaagtttatttctagaatgtgaaaacaggaggccttaagaggtttctttttttcttcttttaaaaatgtgctatcagtcatggtacttttagagcagcaggaattatttacctcatctagtggagaaaacactcttaatcatttgaagaaactgttatttttcttaaaaaagaaaaatcaggccaagcacagtggctcatgcctgtaatcccagcactttgggaggctgaggtgagcggttcacttaaggtcaggagtatgagaccagcccaggcaacatggtgaaaccccgtctccacaaaagtacaaaaattagccaggcgtggtggtgcacttataatcccagctactcgggaggctgaggcaggagaattgcttgaacccgggagatagaggttgcagtgagccgagatggtgccactgcactccagcctgggcgacagagcaagactccatctcacaaaaaaaaaaaaaaagaaagaaaaagaaaagaaaagaaaaatcacaagttgaaaaattgaggccaaacctagttctgtggagaaggagataagataaaatagcacactatgaaaatcgggccatggttttatatgtgtggcaggtcaaaatgccaaatatatcttgctggctccccccacacgccccggcattaagttttcagctattagtaagaaatctcaaaagaggcttctaagcatttatcaccaaacttaggaaatgtactgaagtataggtgagtattgcatgactttaaatacagcttttaaacatgtcaagatgtgtttccatgctctgaatgcctagttttaaactgtcttgctggctggtaaccattcctggttactaactcaaggtatgatccgcacttaggcaaagctcactgttaatgagaatagaggtaagtctattttccaactagtcttgataatgtttaagttttcttagttcttctttatcaaatccgattagcctgtctttgttcttacacaacatgatgaagagctcatcctggtggaattgtcggccccactgttctcggaaaacccccctgtgcttaggtgttgggatatcttcaattcgaggttactttttaggaactttttaagcctcttatcagtttttgaggactggtgtcattaaaaccaaataacatctgcaaatccttcactcagttggccacctgtacggttagtgattgcacggaaataagcaaggtggaatgagtacacgagcgaaggctccccgagcttccttcaggacagccgcctgccttcctgatacgtgcattcctggtacatgcatttctgctgtatggaccccaggaagatgtcaatgagatttaactctaacacagaacataaatataaattaaaacaaatcctggttttcttcctgcaccctgaggagttatcttgcgttccctgcaggggcacctcactgtgagatggctacgttagagaatcttctcaggaagggctcttttggaaaaacaatgtaaagtgtaaaatactctaaaaattactagagtggctcccaagcaataaagagaaattggaaaatgccagtaaacaaaaaagaagaggaaaaccccttaattccacagaagttaaccaccattactaatgctttgcttcatctcttctgaaagctttttccaaggatgtgtctctctatagaacttctttagaataatatcactgtggaacctatcagttagggtccttgaccataaggacagaaagcaggactcactggaaggcacctgggctgaggaaagagtgctcacagagcctactggagactggggcaccaggctcaggccaacaggagccaagggggcatctgagggcaaggaagcatggtgcaagaggatagcaaacatcacacaaccggaacagcccgtgcagggccgctgctgcaggggatggctttgcactggctcaggttcaaggcctgcaagacacagcccactgagctgagctccgtctggcctgggcaggcaaggaaggaccttgcttctaggcagccatgtggaaggcaggaatcctccaaccaccagctacaccccgctggagggagaaaatactctggtgagaaatcagggtactattggggaagagaaataaataaataataaacacgacaatactacaggatcagaccatatatgctattatgtaatctgctattttaaatgaatacataaggaacaatctttccatgatagtgtgtactcacctaaaacataactttgagtgactggatagtatcttattgtttggagataccttaattaattaattaatttagagacaggtctcactgtgtcaccctggctggagtgcagaggcacgatcatagctcactccagcctcgaactcctggcctcaagcaatcctcccaccttggcctcccaaagaaccgggattagagccaccacacctggcctatttaattagttcctcatacttcataatttaaataattttcagttttcactattataataaattgtgaccaatatcctagtagttaaatcttaatttaattgttcacttagaatacattccgaaaagcagaactgttgggtcacctttaaagtgatggggacctatttttaagtcttttgctaatgtgttttcaatctgtcctgcagaaagattgttcccacattctaaaccctcctcagcatatttttgctttttattttgcaattagatagggaaaaatagtatctcattgatcttttaaaaatttgcattccattgataagtggagctttctaaaggcccacagcaatgtactgaaagattcaattggattagctccaggaagcaccaaattggagcctcacagattgttttttcagatagaaacaacaaacccctcggctgctatgaaatggagcccacaaagcacaacatgacagacagaatctgaattccagagacacagtttctttcagaacaaatattatttgcaggaggcaattagaatgagccactattgcacagtagacttagcaggaaatgcacaaatattcaagcaacaaaataggaactggggaaataagcctgcaaaagaagtgaagaatgtccaacacaggcgggacgaggggccaactggcctcccgcgctcacaccaaaatgccagcttcttaggctgtgacagtgtttcctaatgcaattcatttgctcattcagtcagcattcattggattctcaccatgtgccagacactgtgctgggtaccagagatgccaaaatgagtatgaaacatagcccttgtccttgagagatttcagcctcatgggagagacaggaagaccaataatgacactgagcaagagttgttcagcaatgttagcaaagtgcattggggtcaatgacagcagctggctctgcctgtgggactcacagaggacttcatagaggaagtggcaggatgaactgcaaatgttttatgtgttcacattggcaattctgctgccaatactggggggtgagaatgttctagaatgagatggcttgaggctaatgctgaagtagctttttaatagcatggcttagggaaaagagtgctgaattccagctgtgtcaggtataggatatgtgacctggggaaagtcacgtgatgtgtctgtcctctgttgcccatctgtaagtgacagaaatcatagctaccttgtaggcttactctgagcatgatgggctgtctgcacacagggcttagtaagtggtatctgtcattacaaagtgttcagtaaatatctgctgaatgaatgaatataaatattttctctatatagtaaatatcttcaattatataacgaggttgggtacaggtatttataggatgtccgggagtagggaagtccattttcctaaacttgtgacctcagggacttcatggaaagggtgtacatgtcattttaacttcattcattcaataaaatatttaattagtgatattctatgctagaaacaattctagtaaactggtcgggtgtggtggctcacgcctgtaatcctagcactttgggaggccaaggtgggtggatcacttgaggtcaggagttcgagaccagcttgggcaacatggcaaaaccccatctctaaaaatgcaaaaattagctgggcatggtggcgggcgcctgtagtcccagctacttggaaggctgaggcaggagaattgcttcaacccaggaggcagaggctgcagtgagctgagattatgccactgtactccagcctgggagacaaagcaagattccctctcaaaaaaaaaaaaagaaagaaagaaagaaaagaaacagcgctagcaaacaaaacaaagtccctgtccttaaggaacttgaattctggctgtgaggttgacagtaggaggcagataatacatcaataaacatatgtcatgtcgggattaacactatgaagaaaaatgaagcaggataaggggtgagagtgatggggtactgtcctatctagaatgacatggaagtcccctctaaggaggggatcttgagcagtggcctgaaggaaatgaaggggcatggggaaagggcattccttgtagaggaacatcaagcaccacgtgtttggcagccagcaggatcagcaaggagcaccccaggcctttgtggcctgagtgaagagagagaagcagatgaggacggagaggtgggcagggccccgagcatgaagggccttgtgggccaggaaaggatttggagctaaatgtggagagaagaagagatgccattgaatggtgctgagccagttaggggacattaccagggagatggtgtctcaggccggggagataatggtggatagtgaaaggcggttggatttgggatctatttggaaggtagaagcaacaggatttcccagtggatgggatggaagtagagaaaaagacaccaagaatgatcacaaggtttaggtctcagcaacgacatactattcgttaaggttgagggggaagatcgagagtgtggtttgagacgtgttcccactgagaagccaaccagacatccaggctgtctatataagtctggagctccggagagcctggggttggagtggtcagtgcaccgaagatgtttaaaaccgtggggctggatgggatcccctaaagagggagggtgagtagggaagagaagggctccgagggctgaacctgggggcaacccaaagttagagatagggaaggagaaagatcagcaaaagatacaaggcaaacatagtatcagggcaatcccaggtcctattccgtcccccatcctgtgtccccagggcctccatcacccagttgtttctcttcagtgtccttcggagtccctgaggcaagctggactcacatagactagaaaattctagtgtattttgtgtgcaacccagtggtagcgccgcgtttttcagttgctttgaaatctacgaatatcccttctcatcacagtccgagtgaactgtcctgatgctgtggtttctcagtgtctctgaaattcttgtgaccttcagtcctgaggaccattcttctctgagtagggaggccgggggtcaaggccgggcctgactgccattgttctgactgcagaactgaacggagttcgatccagcggagcccgtgtggcggctgtcgaaagtaagcccttcacaaaaatggtgtgcctaaaggtaactgcagaggcactggggttcttaattttaaactatcagaaaagaatgaacgggcaacatgtgatcctcaggtgtgaaatgcaaccatcacacccttgtcccagaaacaccgtttcattttttctaaatcaagtgtgactccagtcccttactggccagtcataataagaggaggcctgggggtttatgtggtgcctctgaaacctaacaatacggaccaagaacatgacaactgttgaacaccaaaactggctccgtcacctacatcatcgcctgagcagccctgtcccctccccagtccactgctccggaaactggaatgacccttgtgaggaaaccagtgagaagcttgagcagttctctcaagggggggctttttcaacagattgttgaagggactatatcgacatgacgtttggcaaaagcccatagtgagactagaggagagaaagctgagtgacagccagaccctaggacaagggaagttcttccctccagtttgcccgccagccaacagcacagccaccagccctgcccacccttctgatgctgggacgcagccccgccctgccccgacaccaggccacaggccacaggccctgtcaacagccttcccattcctggcccagagaccctacctgctctctccagacagttcagctgtttgttcatgcaaagcctttctgaaaacaaaggcctattaattctgccccgtttgcaagtgaagccccagttctgtgggactcaaagcacacgctgatcgcttgagggggtggtgagaagacgatgtgaggaaggatgacttatttttttctcttttaacagcagaaggaaaaaacaaaaaatagtaactccataaatcatcctgccaggcagagaggaatctcccatttttaagctacaatacacgtttttgtaaaatgttttactatagagagttagtagacaatggtacagtgtatctccatgtaacatcaccctccccgccggccatcaactcgaggccaatcctgtccccatctccagaggtcacctccctcataattttgaagcaaatgtaaggcattattttattttattcataatttttttcagtaggtatatttaaaagatacttaaaaataaaggctcttaaaaattacctataatactataatcgtccctttaaaataatgatggtttggccgggcacggtggctcacgcctgtaatcccagcactttgggaggccgaggcgggtggatcacctgaggtcaggagttcgagaccagcctgaccaatatggtgaaacccagtctctactaaaaatacaaaaattagctggacatagcggcatgtgcctgtggtcccagctactcgggatgctgagacaggagaattgcttgaaccccggaggcggaggttgcagtgagccaagatcatgccactgcactccagcctgggtgacagagtgagactccatctcaaaagtagtagtaataataataataataattgtttaatgttatcatatatccagtgtcgaaaagatcagttttcccgtaaatgaataaatgaccttaaaaaaatactatacagaggcctggcacagtggcttatgcctgtaatctcagcactttgagaggctgaggctggtggattgcctcagctcaggagttcgagaccagcctgggcaacatggtgaaaccctgtctctaccaaaaatacaaaaattagccaggtgtggtggtgcacgcctgtagtcccagctactcagggggctgagtcaggaggatcacctgatccttgggaggttgaggctgcagtgaacagtgatcggtctactgcactccagcctgggcaatagagtgagaccctgtctcaacaaaataaataataataataataataataataaatacttcacagtttgaattaggagtcaagattcaaactgtgaatcttgtgattggctaacatgggttttttgtttgtttgttttttgagatggaattttgctctgtcacccaggctggagtgcaatggcgcaatcttggctcactgcaacctccgcctcccgggttccagcgattctcctgcctcagcctcccaagttgctgggattacaggcacccaccaccacgcccgactaacttttgtatttttagcagagatggggtttcaccatgttggccaggctggtctcgaactcctgacctcaggtgatccacctgcctcggcctcccaaagcgctgggattacaggcatgagccacggcgcctggcctggctaacatgtttttaaagtttcttttaatgtgtagtttttactcccaatctttcttttatccttgcagtttaattattggaggaaccaacttgtttgtcctgtagaatttcccacatcctggttttgctggttgcatcatcatggtatatataattaatgtatttgtctgtcttctctacttgataaattggcaattggatctagagcaaattcaggtttgatttggcgggaccagattactttacaggtgttgtatccttctatcaggaagtacatgatatctgattgtctctctatgacgtcagtactattgttgatgaacactaggtctatattaatacattatggactgcaaaatggtgataatctaattctatcattcttcatttactagtatttccttgatttataagtattttcctttatcagttttcaatattttcaaggtttctcaatattccttaacagcaaccaagtagtttttaaaattattttttaaaattgatacataatagatgtacatgctttcagggtacatgtgataatttaatatatttatatcaagtattttttgctttttagtattataataaagtcatgaatatttggtatatttcaatccattgtcgtcattattcttattgatgttcacagtatcccatttttgaacagtgggagctgcttcaggttggattctaaaagcttcctggatatatggcataagacgatttaggttcatcttgtacctattggtttccaatgacgttatcaatcttttgtgacacgagatcagggccaacagtgggtttttgctaatgatgtgttattaggcaataagtagaggaagagtttggtttgtgttagagatttacagatcattttacttgcttttgcaccgtgcttctacacaatagtgcacagacacacaactcactggttaaatggagaccacagaaatctctgggacactttatgagcagcctaatatctcctgattctacaagctagattggagaatgcgtctggagcctgaggccaaactgtggtcctactagttctcaaatcaagacaggattcacctgtggggaaaacgatgtgtacagaacctctgaatccattgtaataatcagtgtcattaggaactttatttatttatttatttatttatttatttatttttgagatggagtctcattctgtcgcccaggctggagtggaattatgtgatctcagctcactgcagcctccacctcctaggttcaagcgatcctcctgcctcagcctcccaagtagttgggactccaggcatgcactagcactcctggctagtttttgtatctttagtagagacggggtttcgccatgatggccaggctggtctcaaactcctgacctcaggtgatccacccgccttggcctcccaaagtgctgggattacaggcgtcagccactgcacccggccacttttaaatcccagtggcaggagtacttatagatttgccttaaattcccatttgttgggagaacaaaaaacatacaaaacagagtaggaggcaggtccaatacagactttcgaaaagtgataaaatgtggtaaaagcaaagcttcacacatccaatcagatgtcttcctcataagggaaagaacaagtaaccagctggagaggcccagcattgtttatttcagtcctccaccctgtgaggctgacgaggatgagaggtggtcctctatggtcaggaggggggaccagagaggccaagcattgtttatttcagtcctccaccctgtgaggctgaggaggatgagaggtggtcctctatggtcaggaggggggaccagagaggccaagcattgtttatttcagtcctccaccctgtgaggctgacgaggatgagaggtggtcctctatggtcaggagggagaccagagaggccaagcattgtttatttcagtcctccaccctgtgaggctgacgaggatcagaggtggtcctctatggtcaggagggagaccagagaggccaagcattgtttatttcagtcctccaccctgtgaggctgaggaggatcagaggtggtcctctatggtcaggaggggggaccagagaggccaagcattgtttatttcagtcctccaccctgtgaggctgaggaggatcagaggtggtcctctatggtcaggagggagaccagagaggccaagcattgtttatttcagtcctccaccctgtgaggctgaggaggatcagaggtggtcctctatggtcaggaggggggaccagagaggccaagcattgtttatttcagtcctccaccctgtgaggctgaggaggatcagaggtggtcctctatggtcaggagggagaccagagaggccaagcattgtttatttcagtcctccaccctgtgaggctgaggaggatcagaggtggtcctctatggtcaggaggggggaccagagaggccaagcattgtttatttcagtcctccaccctgtgaggctgacgaggatcagaggtggtcctctgtggtcaggagaggggaccggaggagggtggtctgggaagcactgcttgactcagagcttcctagtaccaagcactggatccactaaagaaaaggtggggagaggaagagtggctgcttgtggagtgggctatggctggaaactggtgagaaggtgatgacaaaagaaggcccattctcggtctaaaatctgtaaacaagatcctaagaagggagagtgggcttagggataagacagagtaaaaagaggcggggaagttgcagacggaatacgccgagccagcgacaatgactgggtggttcaaactttctttcctgggacagtggaaataagaagaggtgctcactttgatggggatgtggggatataggagaagagcctgtggatggagcacaaccaaactgaggttattgtgcagctggttttgcaagacactgatcaccagcataggtgattaaaaaaggactttctattaagaaatgttaacccttaaagagtaggatcaatgggccgggtgtggtggctcaggcctgtaatcccagcaccttgggaggcccaggcgggcagatcacctgaggttaggagtttgagaacagcctgaccaacatggcaaaacctcgtctctactaaaaatacaaagagcagccgggtgtggtggcgcatgcctgtaatcccagctactcgggcagctgaggcaggagaatcacttgaacctgggaggcggaggttccagtgagcggagattgcgccactgcactccagcctgggggacagatcgagactctgtcataaaaaaaaaaaaaaagaaaagaaaaaagaataggctaaatggacccccgtgtatttattaggcattgccattaacatatggccaatcttgcttcacctattctccctcaacagtttccctcacctccatcctcacccctgctcgttatttcaaaacaaattctagacatcacatcatttcacctataaatgctttgatgttatctttaccagaaaaggtagagataaggacctccttccccttttccccacacaaccattaaaccacgatcatatcttaaaaagctaacaataattctgtaatgtccgatatgcaatactttcaaatttccgctcttgtctcataaatatgcttttaccattggtttattccaatcaggatccaaacaaggtcctcgtgttgcatttggttgatgcgtatctaaatctttaactttccctccccttttgttcttgtctttcatttgttgaagagcctggtctttggtcctgtagaattgtccgcacgttggacttgtccgattgcatttctgtggttgtgtttaacacgtccctctattccctgtatttcccgtagaccaatttttatatctagaggctcgatcaatgtcaagttcagttttgtttttgttttttctttccttgcaaatcaacttcattggaagtggtgaatttttattgccttccttcaggaggtaacataatgtctggattgtctctttttgtcactcctcatactcagtagctgtcagcctgatctaggctgtatgaagctctccatcaacctgtcacctaatggttgccattaacattattttagtaggagttgcaaaatggtgatttttttttaaaaagattctatcattccttcttcatttatgcagtggaattcctctattaaagataattttctgaagaccagcctgggcaacatggagaaagcccatctctactaaaaatagaaaaattagccaggcatggtggtgtgtgcctgtagtcccagctactcagggggctcagggctcagggagtataacctgagcccaggacatggcggttgcagtgagccatgatcacaccattgcgcttcagcctgggccacagagcaagaccccatctcaaaaaaaaaaaaaaaacaaaaaacaaaaacaaaaacccaagataatattctgccatcaactattcggcttctttgaaatactgtttgttcagaaaaggcacagcagtttgcttcttttctttaatttttcaagcaaaatatttcttgatttctcttgaaaacatgcatttttggctggatgctgtggctcacgcccataatcccaacactttgggaggccaaggcaggaagttcacctgaggccaggagtttgagagacgcctgggcaacaaagtgagaccccatctctacaaaaatttttaaaaaattagctgggtatggtggcacatgcctgtagtcccagctactgaggaggccgaggcaggaggatcacttgagcccaggagttcgaggctgcagtattgcactccagcctggacaacagagcaagaccctgtctctggaaaacaaacagaaatatgcattttactttcgtaagtgtgtgtgtgtcataggtgggccttaaaattgcctgtatcccttatgagacgtataagcctccctttggcttgtgtgctagccaaaccacacttggtaacattcttcttcccttattagtttctggtgatttacagtgtttgcattagcagttacactgctctttctgtcacagtgaatctctctgggaggaagtgaagtgtttggacttgatttaatgaagctatcacagactgataaaacaggtttcaaatatcatagggttataaggaaaaagatgatttagaataattatttagataaatgataacagtacaccatgaattccataataattctgaatataactcttccctatgttaaataattaacatttacaaccatttaaatatatttcaatatttaatatatttaaattgtatatttaaaataatgtatatttaaaaataagaaaaatgttcacacaactcaaacttgcaccttgttatatctatgtttcttccattttaaattttgtcattcatcgatatgaactggttaccaataaatttggatttgtaagctaggtagaaagttggggaaatttctgcaggaataaccaggattaaccagataatttcaagattttcttgatctaggaattaagaattcatatgatatggtggcctggtgcagtggttcacccctgtaatctcagcactttgggaggctgaggctgacggatcacctgaggtgtttgagaccagcctggctggccaacatggcaaaaccccgtctctactaaaaatacaaaaattagctgggtgtggtggcgggtgcctgtaatcccagccactcgggaggctgaggcaggagaatcgctggaacccgggaggcggaggttgcagtgagccaagattgcgccattgcactccagcctgggtgacaagagtgaaactctgtctcaacacaaacaaaacaaaaaacaaacaaaaaggaattcatatgacatgggaactagaactatttccaaacagttgtaatccgattccaaagaaaccctgcacttctggtttcctgatgatgtcacccacataaatggctacgtcaaggagtcggtcctgagagcagcgaggcaggagtgaggtcgagtgggcaggcgtgagagccgagcacaggggcagaaaggaagactctgcacccagaaagcggaaaggaggcaagtgggggacaggggtggggtcactggcccaggcactatgggactgcacatcgcacacaacactaacttcccttaataaacactaagttaatctttacaactcttcagcaaggccgtgcaccccgggtccttctgttctgatcggaggacctcgcctcttattcagcagagagcgtagaacctttggcctctaacaccgccaaatctccctttcacagaccaactggcatctaagagctctaggggcagaagtgccgctgtggggcactgatggggcagggactgtggcgcaggtcacctcctgcctttgctgtctgacgcagcctcccagggctgcttgcatttggcaggggctcctcctccacgctgccctctcctggttctcagtcctgctcggtttccaggcaatcacagccccctgtgcaccactccaggcaccgggctcctaaagcagcccctttttcagagctaccctttagttggtgacactctccactaccaaccccagcccagcccagattccctccaagcacagttgtgctgggcacaatagtcatcatctctaagcttacctgtgatttcatccatcctcacctcgtcaccgctctcagaagctccgcgtcctcctggaggctaactcctcctctgctgttgttcccactccgggctacctcctcactgcccttcctccaccagagattccctccatgctctccccttgactttgtcaccatccctgtgcttatcgctttcagaccacagtcttagtcaagtccaccccgtcttttcaaagaacaccttcctttcctttagacgtctctccccgtcacccacccgtcacccagtctctctttccctccctccaccgccaagcattctgaagaaatgttcccctcaccctgagcttgctgcccctcccttccatttcccagcctcctgcagtctcactctgtctccagtacttactgagactgctgaggtcctcagcgacatgcccattgccaatcccagcagcctgtgtccagttcttcacgttttttgaattcactgcaacattgaatgcttgccagtgatgcctccttgctgaaattcttccttggatgaaaagacacattgtttccgggttatcccttttctctttgactattgcttctatgtcttactgaggcctctttctatttccacccttaaccattagtgttcccaggattctagcctcagctcaacttctttcatctctcccagtagcctcattcatccccgtgaccccagctacacttgcaaggactcccagatccaaacctttgatccagcctttcactgagacattctccagctgaatgttgtgctggtctctcatatgcagcagagtctattcctcctcctctcagctctcttttctgtccaacctagaccacaggcatcagtctctaggacttgcctcagcgtctctggggtccctccttccactctactcctataatacgagatgattccagccctcatcccctccttccttgacagttgccatagcctcctaactctgcctctaggctcagccccatccgatccattattcctctgcttttagaagtatttttctaaatagatatggccatggcttgtacctcagtatgggttttgtcaaaagcagaacctgaaacgaggattctggtgtagttgttgtatttgggaggaaacaatagtatgtgagtagggaaggaagacaggaaagggaagcaggccagtaaagggtgtgttgtcgagccagttacctctgcacgtaactggagctgaatcttgctgggcaactctaggagtctcgtagaatacatgcctcagagatatcctgcctgaggggcgagagagctcggttatttatactccgactctcatcaggcaatgagaggtgtcaattctgtagcagttcattcccctcctgcatgtacttggaggcagggggctcatgaaccccttaggcagtagaagtcaagccagctattgcaatggaaaggctcaaagggctagagaggggcacagatggaaggacagggacaatctctgtctcattaccctcctgcttaataatccccagaggtccccactgcccacagctggcctttctggcctcctcccctgcactgcttccctccattcacacaagggttctgaggtctttcctgaagaagacaagcaccctcatgccggtacgcctgggtgtgcatcgctctttcctccacatcacccttcgcttttaggttaactgataatactggccgcacgtactgggcacctgctacctgcagagtcatttatgtatgttagttgatttaatgtaacccctataatagcatatgagttgactagctaaaaagaatgatcacttccattctacaggtaaggaaatcacagctcggagaggttatctcaatgcctctggcacaaagctagcaagtggcagggccatgttgggagacccggctctctgctacaaagcctgtgcgaggcactaaccactgggctgaactacctcagacttcctgcctcagctcggcggtggcctgtccttgctccttctcacctaaatagatgtgctatcagctctgtcttcccatagcctatggtactttttttatgtggatgtctttattaagcgtgtgttatcttgtagtgtaagtatttatcatctgacttcccttttaaaccataagtccctcccattttaatcttcaatgcttggccaattgcgtaactggagtaaagacttcgttaacttttaaaagagcattaagttgaattctgctgggcacagtggctcacgcttgtaatcccagcactttgggaggcggaggcaggcggatcacttgaggtcaggagttcgagaccagcctggccaacatggtgaaacctcatctctattaaaaatacaaaaaatcagtcgagcatggtgatgcacgcctgtagtcccagctactcagagagctgaggcaggagaatcacttgaacccaggaggtggaggttgctgtgagccgagattgcaccactgcattctaacctgggcgacagaatgaggttccttctcaaaaaacaaaacaaaacaaaacaaaacaaaacaaagaattaagttgaatgaatgttgactttgtttcaataccatgcacacaaatactgaagaatgagacttcttaaataagacaggacctagttttgacttttctgggcatattctgctgggcaggaaagaaataagaacattaactctaatggaccacagacagatggcctgccagccagacagcgccccgctgagggccagagcagggcctttgcccaaatcaaggaggagcctattgtttcttccagtttgtgtatggaaggcaaaaacatacaaacaaaaattctttgaaagctcttcaggctctgcaatttgggacatgtttatagggcatgtgtaagtcacagtggtcagtggctctgtggccacagaaggcattaagaggaaatgttagtggcctcctcaccctttgttccttaaagggcttctgcattgacaccaacagccagaagggtttgctagcttttagtgtggttatagtgtggacttagacactataaaatgggaggaaagaaagctcctttttgggaagaaacttctacctatgtcagctatggtataccagctcacagagtgctaagaaaaaataaattttttaattaaaaaaaaactacatgtgcatgtttatgaaaacctggtttcacaatcagaatactgaacctgctaataaatttataccagaaaagcatgcatgctttgctgttaaaaattaactttataatttactttttggcaataggggataatgagaaagagcagcaaagatatctttaaaaggcagcagggagtcagacctcctcctcctttcttcacccaggtctgcactcgtgggcactgagtcgagaccaccaaatgcatgtgggtgggtctgatacccggtgacctgcagggacagcagcactcccagcctctgcccacctgctgaccgcagggcaaagtgtctagttgtaaaaggaaagtatggctccttctcccctcaacctggccgaatcttccaaagtcatttgcagaatattgactgcacagagcgaagaacactttgtttacaatgcagttggtgcaaaatgaatagactaatgaaggtgacgtgaatgtctttgactcatatttatagattttggcttctttgtttcctcttgaacgtattcgcagtgcctcctttctttgtctgtcttctcttcactttcatcaaaggcagcctgttccttctgaccttgaaatttcttttgtaaacatcatgcctgttggcacctgaacccacctaaagtttaaggggtccaggggtaaggggacttttagaaaaccctgctgtcctatggccaacatcagataactggggtgggacatagtagctcatgtctgtaatcccagcattttgggaggctgaggcaggaggatgacttgagcccaagagttcaagaccagcctgggaaatgtagtgagactccgtgtctatacaaataaaaaaaaattagctgggtgtggcacgcacctgtagtaccagctactctgcaggctgaggccagaggattgcttgagcctaggaagttgaggctgcagtgggaagtgtttgcgccactgcactccagcctgggtgacagagcaagatcctgtctcaggaaaaaagataatctggaagacgttattatttgtttttgtttgtttgtttgttttttagacagagtttcgctcttgttgcccaggctggcgtgcaatggcacaatttccgctcactgcaacctccgcctcccgggttcaagcgatgctcctgcctcagcctctcaagtagctgggattacaggcgcacgccaccacacccggctaattttgtatttttactagagatggggtttctccatgttggtcaggctggtcttgaactgccgacctcaggcgatctgcctgcctcggcctcccaaagtgctgggattacaggtgtgagctactgcacccggccttatttgtttttatggatgatccttattcctttacttatttcatttaaagttacctttaagattattggagcttaaaaaagaaatatgcagctgagtgagaaaaggttattgaaaattttactatatatgtgtgttcatatgcttagagacattgtgaaagcaggtaacttttaaacttctttatacttttacttaactgtggtggaatatacataacatcaagtttaccattttaaccacttccatgcatatagtccagggggattaaataaattcacattgtcgtgcagccatcaccctgatccttctctagaactttcttattccaaatggaaattccatactcctcaaacagtaactcccgttcttccttcatgttacctttttttttttttttgagatggagtctctctctgtcacccaggctggagtgcagtggcacggtcttggctcactgcagcctccgcctcctgagttcaagcagttctcctgcctcagcctcccaagtagctgggattacaggtgtctgccaccacgcccagctaattttttaattttggtagagacagtggtttcaccatgttggccaggttggtctcgaactcctgacctcaagtgatccacctgcctcggcctcccaaagtgttgggattacaggcgtgagccactgcacctggcccctgatactattttgagtgtgattcttacagtagtatcttatattttaaaaaacaggatacaccttaccttggtccttaaagaatatgtttgcttattctgctgtggttccaagattatttttcctataaagtttcccccctaagagcttatcaccgtgtcttacaggcgagtcagccaagtaagacatgatgaaaatgccagtgttatgaggttcccaggcgctccttcataaagatcctgagaaaagcttttaagaatgtatctaagagttgctttcagggatcttaactcaattagtggaggttgctgaccacaggccatgtctagagcacagactatatcgtcacgttactctgttgtcttctcattgttcaattcagcagcattttagaaggcccgctgtgtgctctgcactgtgctaagtactgcgagaaacagaaaagttgaagacgtggttattgtctgaaatggcagctcctgggaaaaagtgccgtagaaagaggagctggctatagaaaatatggtaatttctaacctaaaattaatatgccacttatgatcatacaatacgaacattaacgtgttcaaatatgagaacaggaacgaatgctggaaatatattaaagtaataacaaacaataataatattaacacctaacagtcactaagcatctgtcatgtgccaaacgccacactcgacactttacgcgctttatctcatttaatcccaccaagaacaagaagcttacggtgatggctcttgtccccagtttagttagaaaagctgacacacacagagattaagggcatggtactagcaagtgatgacgtggggctcccaactcagacctgcccgactccacggtccaaggctggtgtttgtcattgttgggacaaccattggtacactgtgatgtccagtctggaaataaaagagagtggattttgttctgttacattttatttttcacagaagtgaaaaggaaaaggaagcaattcattttaaaagcatccaaaagcaggatgttgtttctgtcacgccattgcttgggatctgctaccaactcccttactggtagcttaggcctcactggttgggattcttttttttaaaaattgtctgcctgggccgggtgtggtggctcacacctgtaatcccagcactttgggaggccgaggcaggcgggtcacaagttcaggagttcaagagcagcctggccgatatggtgaaaccctgtttctgctaaaaatacaaaaaaattagccaggtgtggtggcaggtgcctgtaatcccagctgcttgggaggctgaggcagaagaattgcttgaaacccggaggcagaggttgcagtgagctgaggtcacgccactgcactccagcctgggcgacagagtgagactccatctaaaaaaaaaaaaaaaattgtcttcctaagatgtccctagattccttcatgtacaacatccatggggacaccaccatgcaaagccaagtggttggccagcagccggttcctgccagtcttcctgtcaggctgaggactcgttcaagaggaaattcaccgatgcgtgaacagcctgcctgttcgtttggtgaaatagggcagattttttatttcataaaagtgtagtaaagggagaggctattaatcaaggatttaaattatgatcattattatttattatttttgagacagagtcttgctctgttgcccaagctggagggcacagtgatcttggctcggtgcaacctctgccttctgggtttaagcgattctcttgcctcagcctcccgagtagctgggactagaggcacatgccaccatgcccaactaatttttgtatttttagtagagatggggttctgccatgttggtcaggatggtctcgatctcgtgaccttgtgatccacccgcctcagcctcccaaagtgctgggattacaggcgtgagccaccgtccccagctgagatttaaattatttattttattatttattcatttatttattttgagacagggtctcgctctgtcatccaggctggagtgcagtggcacgatctcggctcatgcagcctcgacctccccagttcaagcagttctcctgcctcagcctcccaagtagctaagactataggcacgccacttcacctggctaatttttgtattttttgtagagatggggtttcaccatgttgcccagactgatctcaaactcctgagttcaagcaatctgcctgcctcagcctcccaaagtgttgggattacaggcgtgagccaccctgcctggctttaagttacttatttaaaaaaattattgcccactctttagcaatggggagggaatagtgtttcttcctggatcttcaggagtggctgtcccttctgggaaggtgcactttttagttgagaagtgaagttcagggaacctggtgacagtgggttaatagtttctcaacttacctctttttgccaactctgacatgtaggactcattcattctttcagtcactgtcattcatttatttattcatcagtaagtgccttccttgagcatggcacaccaaactatgtagcagggctcaaagaaccatcgtgcacagtgcctgccctcatagggctggctgtctagtgagggaggtgggcgtgtgaacaggcaaatcacacaccagtggccaacaccagggcagaatgatggacaaagcactgctgatgggcaaagagcacagaaaacaaaatgaccacctgggcctggtgccgtggctcggcaggaggattctttgaggccaggagtttgagaccagcttgggcaacagagtgagatcctatctctttttttttttttttttgagacagggtctcactctgtcgcctaggctggagtgcagtggcgtgatctcaggtcactgtagcctctgcctcccgggttcaagcaattctcttgcctcagcctcctgagtagctgggattacaggtaccatcgccatgcctggctagtgtttttgtatttttagtagagacggggctttaccatgttggccaggctggtctcgaactcctggcctcaagtgatccgcctgcctcagtctctcaaagtgctaggattatagacatgagccactgtgcctggcctaaagatcctatctgtaccaggaaaaaaaaaagaaagaaaattagccaggtgtggttactcacacctatatcccaattacttgggaggcggaagtgaaggctgcttgggaggatcgcttgaggccaagagttagaggctgcagcgagccttgactgagtcactgcactccagcctgggcaatggagtgagaccttgcctcttaaaaacaaaacaaaacaaaacaaaaaaaactttggcttgaggagtctagaaattaggaggtgacatctgagctgtgtcttaaaggacaaataggaagtttcgggtggagctggcatctgcaagagcacaaagccccaagagctagctagtgtccacctcgtcaaacagaggtggcgtcagaacaagaaactctccagggcaagaggaaagtgcctagatttcttgtttgtattttataccatatagataaaattgttatttgttttttgtaaggctttcagtcaccttgagtatctggctaaaacctattttttatcttaaactatagacacaaagattaatgttgtcaaagtagcataaaagctggtcttgtagaaatattttatcaactaaatacacggaagagctgtataataaaatcctgtctccttagctttttcttgtgtgctgtgtagtacaaaatattttgtttttatcttccttctgtggttaatacttataaagccagcaacgattttatctgacattcagaaatatcaatgtaaaagcctgtaagccctgcaaagaaaattgtttttcttcattcttttcaccaatactgggaagctcccaaagatatccaaggttaagcaatttgcattcagattgttgttattaagtctggtttccttctcttttttgtgagacagagtcttgctctgttgccaggctggagggcagtggtacaatctctgctcactgcaacctctgcttcccgggttccagtgattctcctgcctcagcctcctgagtagctgggatgacaggcactcaccaccacacccggctaatttctttgtattttagtagagacagggtttcaccatgttggccaggctggtctcgaactcctgacctcaagtgatccacctgcctcagcctcccaaagtgctaggattacaggcatgagccaccgtgcccggcctggtttccttcttttgataaatgataacagagaaaataaagcacatccacttatttttattttaattttattttatttatttatttttgagatgaagtttccctcttgttgcccaggctggactgcagtggtgcaatcttgactcagtgcaacttcgcctcccaggttcaagcgattctctttcctcagcctcccaaggagctgggattacaggcgtgcaccaccatgcccagctaattctgtatttttagtagagatgaagtttcaccatgttggtcaggctggtctctaactcctgacctcacacatccacttagttttaaatatgcttcagggcaggcacggtggctcatgtctataatcccagcactttgggaggccaaggcaagcggatcgcttgaggccaggagttcaagaccagcctggccaacgtggcaaaacctcatctctactaaaaatacacaaattagctgagtgtggtggtgtgcacctgtagtcccagctgcttgggaggctgaggcatgagacttgcttgaacccagaggtggaggttgcagtgagccaagattgtgccactgcactccagcctgggtgacagagtgagactctgtctccaataaataaataaatacgcttaaaatgggaaatgatgacttccaggctgtgggatgtttacttaagcaaaaacctctattacgctacctgagaattccattactcaagtttgaataattacaaaactacgtgatgggcctgccctgtctgacttcctgcacacttagaccgagaactgaaagaccctagtgtcaaaaatatttaagatctgccatgagaaatagatgagggagaattagagcaaaccctggccctagggtgcattttgagattgaaatcgcagcctagtctcttccattacaccatcagtaaatcttgaaggacagaagagtagccaagaacaacacagggacaggtgcgctgggcttggctggggagggagccaggtgaggttgtggcttcctgaaggccctcgaagtttgcccctgcagctttcttcggagaactgggagaacaccatgtgtcaccttgtggagcattttaaaaacgagtgagaaacctttatcgggaagatactacgtgctgtaaaacaatgacagtaagccgggcgcagtggctcacgcctgtaatcccagcactttgggaggctgaggcaggcagactgcctaaggtcgggagtacgagatcagcctgaccaacagggagaaaccccgtctctactaaaaatacaaaattagcctggcgtggtggtgcatgcctgtaatcccagctactcaggaggctgaggcaggagaatcgcttgagccccaggaggcggaggttgtggtaagccaagatcgcaccactgcactccagcctgggcaacaagagcaaaacgccatctcaaaaaaagaaaagaaaagaaaagaaaagaaaagaaaagaaaagaaaaaaataatgataacaacagttgatgaaatgctttgatttccagaagacattatataaggagagaactttacttgcatgggacagctgatgagctcctcagctagggagaggggagggattgactcattcttgatgatggggcagggccaaggctgtagggaattgggcattgtctggttgctggtggtatgagatgctggcggagcccaacccatgcctctggctgttatgcgagggtgggaaaattccagtttgctagaaccattaataacacaagtggaaatcatgggtaagtttacagtttattcaagcaagtacttctaattaaacagaaaaaaagagtgtgaactcttgaccaaggcatattcatgattttcagtaaaataatttctcacttctagtggtcaaaataataatgaagtgcgaatatgaagtgaaatgcaacattaagggttggttaaccccaaattctttcatcaaagagcaatatacaagaaattggagagtttttttttttttcatactaaaagtaaccattaagggtaaagaactgagcctggcacagtggctcatgcctgtaatctcagcattttgggaggccgaggcaggaggccaggagttggagaccagtctcggcaacaaagcgaggccctgtctctacaaaaaaaatttaaaagtaactgggcatggtgatgcatgcctgtagtcccagctacatgggaggctaaggcaggaggctgaagtgagccatgatcacgccactgtgctccagcctgggcaacagagcaagaccctgtctaaaaaaaaaaaggaggctgggcacggtggctcacgcctgtaatcccaacactttgggaggccgaggcatgcggatcacaaggtcaggagatcaagaccatcctggctaacatggtgaagccccgtctctactaaaaatagaacgaattagccacacgtggtggcaggtgcctgtagtcccagctactcgggaggctgaggcaggagaatggcgtgaacccaggaggtggagcttgcagtgagcctagatcatgcaactgcactccagcctgggcaacagagcgagaccccgtctcaaaaaaaaataaaaaataagtaaataagtaaataaataaaagagcaaggaactgaacccagtggataatgctggggcatcagatagaggctgttggccatttagttaaaataagatggatgaccataatctgaaagatgtaaaaaaagaaactgacctaatttatttttttgaatgaataaaatatatgtggtacaaaattcaaaaggtatgaaggctcatagagtaaaaactaatttttttttataaatgtgtcccaaaaccactcggatccctctcccctgagtgcaccgattccagggaatccttgtgtgaacaggcaggtagcatccttatgcgcccttcacgcatctctacacatcacacttttctcactaagcaacaggtcccatacgctcagttcctaattgtataaatacccacctcatcgatctcaatgtctgtgtagtattctattgcgtgaatgtgccatattttatttaaccagttcccttctcaagaatatggaagcagttttccatctttcagaaactctgatttatttgtttattatttgtatttttttcctgacaaaaatgctgttcagaacagaaattcgagtttaaattgcagtggctgttctggttcatgtagaactagacttcagccttttcctcattttcttttgcctggtagacttttgcttatccttttattttcagcatttttcaaacattttattttgggtgtgtctcttgtatacccaagcagtgattgcaacattttcagcaattgctataatttccattttagatacagagacacctgtcacttcgcaccttaaatgaagagcttctgagctaatttcttcaatgggaaggcacctcgggggtgatacatgaataacgtggaataatgcaatttgggcagattaccagttaaaagcaatgttaggtttggcccactttgccttgcaggccgctaaagcctcaaacaatatgacacctggccttttacaaagaccggacagtggaggtgttgacaggaatggtgttaagccaggttcatctgggtttgtcaagcatagacttctacttttaaaatatttagggcaaatacagttcaaaattaatttggtcaactacatttttcttaagtttctttagttttgaaacctttgtatatttttattaattatgaaactcatacaaatgttatgtaggcagaattttcaggaagttttatgcccctttttataaacctgtaacaaagaaataagtgatataatagggaaatacggaggtgtatttgcagtctttgtattttacaaaattatcatttgaccatagatgtgatcgttgctgttccaagtaacagaaagctcaacccataaaaggaattaactggcttatatgtaacggaagagtccaaaagcagacatagcttcagatgcagcttgatccagggctcagatgccatgatcagaatccaattcttgcatctgtttctttgggttggcttcattttcaggcagcccccttcctcatatcctcaagatggcagagacagcccatggtctttcccttgcagagacagatcaccaggaaacaatacctctatccctagccatgaaacagtcttgaactttattctgacttgatcagccaagtccctgttggaaccatcactgcctagcttaggcctgagacagtgctgcacctctactaccaaaggccgggctggccttccctaaagtgtatgtgctgcgtgggggagaggtacggatctgaaccaaaacgagggctgtccagcgtcagcaaatatctcccgcagtcccagtgcctccagcaggaggcaaagcatcaacccctccgtctggctcctctactgaaaattccctcagcagcctcacaggccttaggcttgtcttagctacttcttcatctacttttttgctttcttaattatttttcttttcttttttcttattttattttattttattttagatggagtttcgctccgtcgcccaggctgaagtgcagtggcgtgatcttggctcgttgcaacctccacctcccgggttcaagagattctcctgcctcagcctcctgagcagctgggatgacaggcacacaccaccacgcctggctaatttctgtatttttagtagagacggggtttcaccatggtctggtgacctcctggtctcgaactcctgacctcaagtgatcctcccgcctcagcctcccaaagttctgggattacaggcatgagccaccgcacccggctgcttccttaactcttgatctcctctctgtatcttgctttgtctagctgttctcttctctccatattcatccaaacatttgcttagaagtacccagaagcatggcgttgaatgtggtacaccttgaacgaagggtgaagaaacgaggcagagtgacttagtagcaagtgacagcacacagtttaaattttaatattagcccatttacaaacaacagcttatataatagtcattcacatacctcaacactcaccatcccctccccactttttttctggagacagggtttcactgtcaccccagctggaatgcaggtggcatgatcacagctcactgtagcatcgacctcctggactcaaggggtcctcgcgcctcagcctcctgagtagctgggaccacaggtgcatgccaccacgcccagctaatgtttttttttattttttgtagagacagggtctggctatgttgcttaggctggtctcaaactcctgggttcaagcgatcctgccacctcagcctcccaaagtgttaggattacagatgtgagccactgtgcccagccaacattcaccccattcaagtgtgcaattcaatggattctagtatcttcacagtgctgtgcaactatcactcctatctacttacaaagcatttccatcatcttaaaaagaatccccatgtccaatagcagttccccttcccccaccgtcatcctcgggcaaccgctaatcttcctgtgtgtctgtggatttgcctcttcagggcatttcacataaacacaatcatacaatatgtggccttctgtgtctggcttctttcatttagtgtaaggcttttgaggttcatccatgttgtaatgtatatccttagttcattcttttttgttaagctcacaaataaaaagcctcactttttatttgaggcaaggagactggctacagggattacagttccagcagtcaaaacgcaactccaagtggcactatttggaccgtaggttttgcttcattttggctggaaaagggtattcaggatgtacttctcccagccggacaagaaaaagggcaaagaaaactggaagagacgtctcgtctacacaaactgctctttggacacagcatcaacctgaccacacccgtgctggccagtctgcaggttgctgacccgccgttaagggacacaggccatactacacttgctagaaaaactgaggcaggaaaaagaggtgcaaggcactgggggaagagcaggtacctatagctttaaagctcagtgttgaaggggtaatccttgcaggaggcacagctcaccaagacacagaccctcccgttcctgttgtagctgactacagtggtcacatcaggctgctcagttgaaagtcgaagtcctccaagttttcagcagtgcgttccagcatcaccaccgaaatgatgataggaattaccaccaaattcctatgcatgggaaaccagatcagaacctgggctgcgtttttatttgtttattttttttactgtgcttggctgtgattgctttggtgctgggatcccccagacctgtcacgagagctgaggggactacaggcagtcaccaccttgcctttggattggcagccctggattaacttctcctgaggtgggtgcaggtggcactcactgtggttaaccactgtttttaagccaggtttctttttttctgtctgtcatatatatatatatatatttagagacagggtctcactctatcactcaggcctggagtgtagtggcatgatcataactcactgcagcctcgagttcctgggctcaagtgatcctcccgccttggcctcccaaagtgctgggattacaggctgagacaccacacctggtcttaagccaggtttctttaccatctcttggagatggctgcagttggagattccaaaagctttcagagcccttcatccaccagctcctccatgtggccacccatgtgacatgaagttggtgtcactaggtaccacgttgtctgtcccatccaacaggaaaaatagcctgttggccagtgaataaggtaggaatccaggtggtcccctgagggtcttctgacaggctcctttatcaggctcttctcatggtatgagcaccgcagcttgctgacagtggcaacgttctcaagcttcacagactccgtcacttggcctggaggggaattctaggtgtccagccccaggacaggcattttggcaccatgattgagcacgatatggtgagccatcctcacaggattaagaagaattctggacagaaatatagttgtaagtaagcatcagtcagcctgcactttgacccacttccttgtaaccaacagtgacgtagcactaggtaacatttgcatccccgttgttcctatagatacaatttctgaccttagaatcacaaggcttttgtttaaaatagatgggatctctgacattagaatcataagatttttgtttaagacttgcttaagatgtttttcagatcctgaattccagcaaaacagccgacaccaaccagtttgaagacccccacagaggaatgtgatcagcatgaaaatacagcttcgtctccctctcccatgactccaccctgcacacttcgaccaatcaaccatctccacactccagtctccactcccaaacccttaaaaaccccagccccaaactcctcagggagatggatttgacgtttcctcccatttcctccttcggtggccctacgatgaaacctctttctctgctacaaccctatgcctcggcgtattcactttctggtcccatccagcgatggacccatcgtggttaccgtggctggccaagcctgctgtgcttcacagaccccactcaggatcacaccacttcgttccactgtttggagatgccatgtttgcttatcccttcatcagctgatgagcatttgtgctgttttcactttttggctattacgaaaatgttgctacgagcatccatgatattcgcccatttaaaaaagtgtttttcaccattactgctgtgggaaatttctccctggctctgtcctttctttgtagcccagccttcccccaggttttggctctccctctctggctcaatgtcagctccttgtctcacctcctagagcaattccactctcccacctcctgctgcggcatttccaaagcctctgcttagcaagggaccacccattctgcacctctccccttagggctgcaagcacctgcacaaacttggtggttatcctatgcctcaactcaatcaaattctctcagttttccatcagcaatctttttaagccaaagggaaggcaaggacttgatcttcacatcacatgaatcatgacacctgccttagaaggcagaagcaactgtagttggaatagcaattgtttttcaacatatgggatgatatcaaggctctttcctccccatatgtcctgccctgttagtggctggggctgagggttttcccaggaagccagattgtcctcacaagttcctcaggaccctagggcttccacagatagtaggactgttatcagaaagaagtctcgatccagacgccgagagagggttcttggatatcgcccaagaaagaattcagggggagtccatagagtgaagtgaaagcaagtttgttaagaaaacaaaggagtaaagaatggctactccataggcagagcagctccgagggctgctggttgcccatttttttttttttttctttgagatggagtctggctctgtcgcccaggctggagtgcggtggcacaatctcggctcactgcaagctccgcctcccgggttcacgccattctcctgcctcagcctcccgagtagctgggactacaggcgcccgccaccatgcccggctaattttttgtatttttagtagagatgaggtttcacatgttagccaggatggtctcgatctcctgacctcgtgatccacccgcctcggcctcccaaagtgctgggatgacaggcgtgactcgtgatccacccgcctcggcctcccaaagtgctgggattacaggcgtgagtcaccacgccgggccggttgcccatttttatgattatttcttgattatatgctaaacaagggctggattattcatgagggaaaggggtgggcaattcctggaacggagggttcctcccccttttagaccgtgtaggataacttcttgacattgccctggcatttgtaaactgtcatggcgcaggtgggagtgtctcttagcatgctaatgcattataattagcatataatgagcagtgaggtcgaccagaggccactctcatcaccattttgggtttggtgggttttggccacttctctactgcaacctgttttatcagtaaggtctttatgacctgtatcttgtggtgacctcctgtctcatcctgtgacttagaatgcctaacaggctggggacgcagcccagcagatctcagcctcattttactcagcccctcatcactctgattcaaatgcctctgacatgaccacgcagatttgagaaacaggccctcagccaaccagactctggctctacgacacacttaatactgtgaaaagaagattacgggtcatagtcacaaataccaggggtgcaaaacttcagattagaagacacttgtcagactcagaggctcatccaactccacggagatcattatcaccacaagttcttcagacaggtgtggaggttttctaagggatatttttattttctggattgcaattttgtttaggaagagatgaaagtgaggatcaactactttgaggattgtacaactttgtaaattgcacaaatatgacggcatatttatatctgcctgcatttgtgaaaacaaacttgtcaaggagcttatttctggaaagggtcaatgattctagaaaaaaaaaaaagataaatatgagacccttcagtaaaaagaaacttactctagggaagttttttgtttttttaaagaagcagtattcactcgtgtttttaaaaaggaacatggatttcaacaataatataatgagtaaagcatctgtttcatttatgaaattagacctattaaagaacagaatcattgagggttaaggtaggatgagagtgacagggaaagaaaatggaaggaaggctaggcacggtggctcacgcctgtaagcacagcactttgggaggccgaggcgggcagatcacctgaggtccagagttcgagaccagcctggccaacatgttgaaaccccatctctactaaaaatacaatatttagctgggcatggtggcaggtgccagtaatcccagctactcagaaggctgaggcaggagaatcgcttgaacccaggaggcagaagttgcagtgagccgagatcactccactgcactccagcctgggcaacaagagcatacctccatctaggaaaaaaaaaaaaaaagaaaagaaaaagaaaatggagaggaaaacaaagaccaaggcgcacccaggccttttgaaagtgaggctgtgacccccgtgcaagcaagagccctgtgtgtggctcccacggtgcctgccacatactagctgctcaataaatggctgtgaaataaatgctgatcacaaaggacagaatgggaaagattaagagagagaaaaggaagtgtggaggagtacaagcagaaataacagcctgggcacagtggctcatgcctgtaatcccagcactttgggaggctgaggtgaaaagatcattgaggccaggagtttgagaccagcctgggtaacaaagcaagaccttgtctctaccaaaaagtcaaaaaaaaaaaaaaaaattagccagggtagtgacacacctgtagcctgtacttgggaggatgaggtgggaggatcacttgagcccaggagttcgaggctgcagtgagctatgatcgcaccactgcactccagctttgggctaaagagcaagaccacatcttgaaaataaaataaaaaataaaaaagagaaataataaccaattccactaacgtaaggcttttccacttccaaaaccctcgccatgacttgattcttatagtcaatccacagggtaagaaagagcatttgtacagagaaagcaataacatttatggtggagaagtgaagtctgtcaccagaggccacactcctgggaggtggtagggccagttctagacgaggacttccatctgccagccccatcctgactgcatgactccacgctgcttctgtcttctggaggcacagcctcaaaatcgggccagtgttgaggggcctggggacagggctggagatggggctctgggaggcatcagcacagggaagattttcggaaccacgagactggtgagaccaccaatgagcggcggggagcgcagatggagaagaggggccggaggaccgagccctgggtgcccatccttcagagggtacagagaagggacggatccgagaaggtgactcggtggaaggaaccagagggagggagtggggagtcctgggagccgcgtggagagtgcatcagggagggaagggggccaccctgccagaatataacagtgcctgatacctagtgagcgctccagaaataagagcccgttcctatttttattaatgtcttgttgagaggaggagcgagcagtgagtacggtaagagctaaattgtcatgcaccacagcacagagtaaagagctgatgtctcaaatggataaatcaagaaacagcagagcaagcgcatttagaaaagcagaggtgaatacctcaaaaacctcaaaatggtcacctcagaggggaggaggacaggtgtggaggggaggggcagccaggactggggattttaaaaaataagccttttgatattatttgcacatgtatttctttgataaagattttttttttaatttttaaatttttgtagagatgggccctcactctgtcacccaggctggagtgcagtggcatgatcatagctcatcgcagcctcgacctcctgggctcaagtgattctcccgcctcggcctcccaaagtgctgggattacaggcatgagccacgcccccagcctgataaaaaaatataagcttcaaaggacacaaaaagagggcttttgcacacgcagttgtctaaggtgattggtgaatggttttggggggctgattgcagagcccaccaggcggcagggctggcgtgcacattctccaggaccccacgttcacactcactgtcctggacatcttccctgcactgctaggacacctcgttctttattcactaagctctttcctggctcagtgagagaacattcagaggccccagcagcagaggaataacaggctccagtggagaagggaccgggaaggaagtaattggaaatctctcttcctcccaggttctatctcctctgctcactccccactgctgagggtcggtacaaaggggggtgacacactcccaccccatccttgtcacactgtgatctcccccaacgcatcagtgcctgcaccttccaggctccggaaagacgatgtgccctttctgctttggaaaatcacagttctcagaagaccaacagaaatgcatgtagaaaatgatggaaattactgggtatcagaggacacgatgacctgaatgagtaagaagatggtgggggccggggggtagggcggaagccagctaggacctgatagtgacaaatgcataactatttgcttattttcagtgccttttgcttcaaatgagaggtttctgctctcccacggtgaagtgtgaggcataaatcctgcttcattatgggggacttccaggggggtggcacggagcccaggagtccctgtggcatgatgagggggaagttgggaaagagaagcagaaagaaaatggaagggggccaaacgcaggaggtgtgaggaggaaagccaaggaagacgaggggagagggaatgataaaaaggagggagaagccgggcgtgggggctcacatctgtaatcctggcacttcagaaggctgatgcaggaggactgcttgagcccagaagtttgagaccagcatgggcaacatggtgaaaccccgtctttacaaaaaaaaaaaaatatatatatatatatatatatgtgtgtgtgtgtgtgtgtgtgtgtatgtgtgtgtatatatatgtgtgtgtgtgtgtatatatatatatatatataaattagctgggcagggtggcatgcacctgcagttcaagctacttgggaggctgagggggagggtcacttaagcccaggaggtcaaggctgagtgagccatgatcacgccactgcacctctaggctgagcaacagagtgaaaccctgcctcaaaacaaaacaaaacaaaacaaaacaaacaaaaaaaaggaatgagaggtagggtctaataggtaggaggctggcccaggaacaagtcggggtgttattctgtgcactgatgcaatgggttaacgcactagtttcctaagcccgtcagggtgagttgccacaaacgtgatggctcaaaacagaaatccaaaatccaggtggcagcagggccacgctctccccctaggtcctaggggaggatcgccctcgcccctgcctctccagctactgctggccccaggcgttcttcgtcttgccgctgcgtcactcccgtccctgcctctctgccttcacaggacctcttctcccgcgcttctccacagtgtctgtgtgtctccaatctccctcttctttctcttataaggacattagtcactggatctagggtccaccctaagtccaggatgatcttatctcaagatccttaacttaatttcatctacaaaaccctatttccaaataagatcacattcacaggtacagggggccatggactgaatgtgtccccccagaattcctatgctgaaatcctaatccctgtgtgacagtatttggaggcggggcctttgggaggtgattacgctgtgagagtggagccgtcatgaatgggatcagcgcctttatgagaagaggctggagaccgaccatgtgaggatacggggggagggtagtgctcttgagcccagaagcaggtcctcgccagaactgaccatgctagcaccttgatcttggatttgcagcctccagacggtgagagacgactgtctgctgtttaagccacccagtcttggcatttcttataacagccctaagtgataactgatttgggtgcccctattcaacccttgttttgacttagatgacattctctacagggaaaatttcttaggactattggacaaaatataaagttcttttcttgctttttggttttgcaaaaaaaagaaagaaagatgaatgggtcaatgagaacatctgaaaagtctggagtatcactgaggaaatagagggcgattgagaatccgaaagtgaatggaaacctacaacagaagtgagatatgcttttctgttgtcacctcatcggactgtgtgtgatgacacaaatgccaatagccggcaaactgcgaggaaccgaacatgatcctgacagtctcaggagtgcccccgctgaatgatttttaagttgaatatctgactaaaataaataattgtctcatttctttgttgatttaaccaactctgaagcctaaaagacacgtgtgaggccctgtgaggggaactaataggaatgtgggcgaatggcgtccttggagagttcatggtctgataggagagaaagattttataggaaatcacagccacaagaaagcagcccacaccccacacgagatggctgtgggggtttggggaagaagatagtgcacccagttgcagatatcagagagggcttcctggaggaggtagcactgaagctgggcatggtaggaggaaggatctgaatgaatatgtggtgagaggaggaaggccattgtgggcgaaggcaaaacagaggtgggagggggcgagctcgtcagggagtaattagtcgttcagtttggttggaccttagagtctgtggacaagagtagcggaggtgaagcatagtggggttattccggggctggctccaggacggccttgaaggccacgcagagttgatgccgcagacccatgattccgaggttgggagagaaggtccagctcacagagaagctccaggggctggagatagtcggagagagctcctccaaaacgcctgatgtgccccgggatgtccctcctaccatggaactgatgctctagacaatgagatccgctaacacgctctgagcagggaatggcaccgccaagctgtgctccaggaaagatgcatctgtagctccttttaagacttaacaggaggccaggcatggtggctcatgcctggaatcccagcactttgggaggccaaggcgggcgggtcacctgaggtcaggagttcgagaccagcctgaccaatatggcgaaaccctgtttctgctaaaaatacaaaaattagccgggtgcggtggtgcacacctgtaatcccagctactcgggaggctgaggcaggagaatcgcttgaacccgggaggcagagcttgcagcaagctgagatcacgccactgcactctccagccttggtgacagagcaagactccatctcaaaaacaaacaaacaaacaagaaaaccacttaatggggatgggacaaatttcatggggcactactgccatctccccagttatgtggaactgagggctgaccaagcggggtggctgtgggaagaggaaagaagcaagccgtgggctctgagcgcttgctcgtgaagcagggactgagctgtctggtgcctgtggggccgggcacggggagaagcttttctggctggacgttcactccttgtttgggttaagataatgtgtgtgcgattgtctcagcctctcatctcacaggagttcctagtgcactgctgatcccgagggtgcgcagatccgcccttgagacactcatctgttctctgatgctcctgcctcatctgttctctgttttccctacactggcagaggggaggatgaatatccacggcccctcatttccttcatttggatgacggaaagatgaaaatgtttcagcatctcttgttgacatgtgagctgcagtaaggcctgaagaatcctctgcccaccgagagctggggcagtgtgtggggtgtggcagagacagaagagacgggaagctggacatcctgtggactcgggtatcagctcaccttctaccaagcattccattcctctgctcaggccccaagtctcagaatcatccttgcctcccttctttctccctctccctcctcatccaatccgccaaatcctaccttcacaatctggccagtcagcatgggtgaaccttgaggacattatggtaagggaataaggcagttcccaaaggaccaacactgtgattccacttatctcaagtacctcagggagtcagattcctagagacagagagtggaatgtggatgccaggggctctggggaggggaaaatggggggttactgctcaatgggtacaaagtttcagttctgcaagatgaaatgagctctggagatggatgggggtgatgggtgcacgacaatgtgaatgtatgtaataccactcagtgtacactccaaaacgctgaagatgcttttatgttgtatgcatttttataataaataaattatacaataaagaccaccgacttcaagttatgatctctcattggacaagagtgacacaggagaagcgtggacaaagtcccccactaccacaaattatgcagttgagtttcctgcatttggagaaatggcaggggtcagcctacctggagtgcagtgggtgagcctcactctgggaaaaccatcttcatgatcatggcaccttccctgccagggaagtatgttatatggactttatcacaattttaaaaatacacccacatatagatttatctctatcatctatatctatctatatcatcgatatctatcatcgatatctacctatatctacacctagatctatatcatctatctccagtgctcctcctcccatggctactggcctggtccaagctgcctttatttgtcatctagatgattgcaatgacatccttcctggtctttgcctctgtaactatgttcccaacgtgtagtcacagtgatctgaataaaacataaaacagacgtgtcgctgttctgctctgaagcctccatttggcctcttatctttcttggagtaaaagccaaagggcttaccacggcccccatgggatgtccaggctggctgtcagtatccctctgccatcacctcgtgctgctctcccctgacttggcagccgcagaggcccgttgactttgctgttcctcacgtagaccacgccgagcgcgctcctgcctcggggcctttgttgccggcatccgctctgctctaaatgcccttccacacagcctcctgcccagggctctcacttcctgcaggtcccagcccagatctcctgttagcaatgaaccttccccaaataccctaggaaataaggatgccccttgccccaccccacactctctgtcctacctgccctgcccttatcaattcctatttatttccgctagaatgtaagttccaggagggcaggtctctttccgtttggttggctgctgtattcctaacacccagagcagggccttgcttttaggcactcaatatagttgttgaatgagtatattgagacttccattccttcaggcaataaatcgatcagaaagacagaggccgctctaggtatttcaagcaagaagagatttttctcttctttcttgtgaatttttgtgggtacatcgtatgtgtgtgtatttgtggggtccatgagatgtttggttcgggcacgccatgtgaaaggagcacatcatggagaatggggtgtccatcccctcaggcatttgtcctttgagttacaaacaacccaattacactctttaagttattttaaaatgtacagttattattgactacagtctccctgttgtgctatcaaatagtaggcctttttcattcttttttttattttttattttttttttacccattaccatccccacccccctactccccttcccagcctctggtcaccatcctcctactctctatgtccatgagtcctattattttaattgtgagaatatgtgatgtttgtttttctgtgcctggcttatttcactaaatacaatgatctccagttccattcatgttgttgcaaatgactggatcccattcttttttatggctgaatagtactccattgtgcatatctaccacattttctttatccactcatctgttcatgaacacttaggttacttccaaatcttggctcttgtaaatagtgctgtaacaagcagcagtgcagacatctcttcaatatactgagttcctttcttttgggtatctacccagccatgagattgctggatcatacggtagctcaattgttagttttttgaggaagctccaaactgttctctacagtggtttactaatttacattcccacccacaagggtccccttttctctgcatcctcaccagcatttcttattgcctgtcttttggatgtaagccattttaactgggctggcatgatatctcatcgtagtttttttgtttttgtttttgtttttttttttggagacggagtcttgctctgttgcccaggctggagtgcagtggtgcaatcttggctcattgcaacctccacctctgggttcaagtgattctcctgtctcagcttcctgagtggctgggattacaggtgcatactgccacacccagctaattttttgtattttagtagagacggggtttcaccgtgttacctaggctggtctcgaactcctgagctcaggcaatccacctgcctcggcctcccaaagtgctgggattacagacgtgagccaccacgcccggccctcattgcagttttgatttgctttatctaatgatcatggtgttgagcaccttttcatgtgcctgtttgccatttctatgtcttcttttgagaaatagctattcaaatcttttgctcattttttgatcagattattagactttttcctatagagttgtttgagctccttatatattctggttactaatcccgtgtcagatgggtggtttgtaaatattttctcccattctgtgggttgtctcatctctttgttgattgcatcctttgctatgcagaagcttttttacttgatgtgttcccatttgtccatttttgttttggttgcctgtgcttgcaaagtattgcttaagaaatttttgcccagaccaatgtcctggagattttccccaatgttttcttgcagtagtttcacagttttgtcagaggcgtttgaatcagagcaactccatcttgaataggatcttggtaacacgaggctgagacctactgggctgcattcccagacagttaaggcattctaagtcacaggatgagataggaggtcagcacaagatacaggtcataaagaccttgctgataaaacaggttgcagtaaaggagctggccaaatcctaccaaaaccaagatggcgacgagagtgacctctggtcatcctcactgctacactcccaccaacaccgtaacagcttacaaatgccacggcaatgttgggaagttaccctatatggtctaaaaaggggaggcatgaataatccaccccttgtttagcatatcatcaagaaataaccataaaaatgggcgacccgcagccccaagggctctgtgtgtggagtagcctttcttttatttcttcactttcttcataaacttgcctccactttactctctggactctccctgaattctttcttgcacgaaatccaagaaccctctcttggggtctggatcaagactcctttcttgtaacagtttgaggtcttagatttaagtctctaatccattttgatttgaattttgcgtatgctgagagataggggtctaatttcattcttctgtgtatggatatccagttttcccagcaccatctattgagactgtcttttccctagtgtatgttcttggcacctttgtcaaaaatgagttcactttaggtgtgtggatttgcttctgggttctctattctgttccgggggtctatgtgtcctttttaatgccagtaacatgctgttttggttactttagctctgtagtataatttgaagtcacataatgtaacttctctagtgttcttctttgttcaagcaagaagagatttagggatctaggaattagagcttcaaaatcactggaaggctagaggtgcgaaggttcaggaaagccattcattgccctcaggcccaccaccagttacaggaaaaacaacaagtttcagaacctgcagaaaccattgccagggtcacatttgcctgcagtaccaaggtgggattcactggggaaatgctcaaatgccaaggcaaactcatgcttgccgtgtttgccacctgttgaagggggagcagcaagccggcttgcctctcttctattttccaaatttcactcgagtgcctctcagcggcccaatctaagttggaatgctcctagttggtatactgggaaatatagtccccaggctttctactccccagtacagagctggcacaccagagtggagaaccagccgacgacccagcagaggcagaagatgccaccctgtgttctcttcttgcttccccccaagttatcctttttgtgggaagagactctccaagaaagagatcaatgatgcagatgaatttcaaggattgaggtctgtcagatttcagagtccacatgtggagggaatgtctaccttaaattaccaaaaggtaatgattatagcttaagtgtattgagctgtactatgtgtccagtactattctaagcctttcatataaattaccgaatttagtcctcatgaggcaagcattattattcatcctcattttattttattttatttcatttctttttttctgagacagagtctcactctgtcacccacgctggcatgcagtggtgcaatctcagctcactgcaacctctgcctcctgggttcaagcgattctcgtgcctcagcctcccaagtagctgagactacaggtgcacgccaccacgcccagttaatttttgtgtttttagtagagatcaggtttcgtcgtgttggccagactggtctggaactcctgacctcaggtgatccacctgcctcagcctcctaaagtgctgggattacaggagtgagccactgtgcccagtcttcatcctcattttatagatgaggaaagagaaagtggaggctaagtatcttgcccaaggttgcatagctagaaagctgtggggccacattttcaaccctggctttctgactttggagcctgagcttctaaacattagattacattccccctcccccataaaggggtggaaacaccagttctgggcatctcagctacaagagcatacatgaaggaaaggctttaaacgtctatgtaaatttgtcaataacataaaaataaagatgacctgaatgtagcacttgggaggtcaaaacagaagccatgagtaggtctcaagaagtatgttgctctgggtcagggaatcctgcaacagcaaagtcgcttgttcactgtggcacggagaggggtaagtagggagaagtgtggcttgcaacttggaattcgaaccctttccctgccacactaacttctttggtggtgttggcatatcatttaggctttttgtattttggggcttctcacagttctaagtgaaataacgatgttaactttatccagagaagaatatgggggaagtcctaatcacttagtataaattattctgaaaaccaaactgctaaagcataatgctctatgctggcagagaagtgaatattgcactagagaatcttccaggtgtcatttaaaattcaacagtgatgggcctccagtaactaaggaagatgacttcacagtctgctagattttacggtcattgttttcaccttgaaagcttgcctacactttcttaattttaatttaaatccatccctcctttgaaacctcctaaactaggtgtgtttctctctttgttctcacccctagacatggacttcctgaaaacagtcttgttttaccagttatttttagattttatacatattctagttgcttcagtcttcactttgaagccatcccttctaagttgtttaattactgtgatcatacactacatttatctttcgggcaataagatgttcagaacagaatgcaatattttagattaagtttcaggctgggtgcggtggctcacgcctgtaatctcagcagtttgggaagccgaggtggatggatcatgtgaggtcaggagtttgagaccagcctggccaagatggcaaaacctcatctctactaaaaatacaaaaattagccaggcatggtggtgggtgcctgcagcgccagctacttgggaggctgaggcagaagaattgcttgaatctgggcggcagaggttacagtgagctgagattgcgccactgcactccagcctgggcaacacagggagactctgtctcaaaaaaaaaaaaaaaagaaaaagtttcaactgagctatttcacatgaaagcaacgcactagattcatgatacatactgagttcctccatatacctgtaaccagagccacacccagtgctgtgctgagtgttagggacacaaagattaaggacctggctaccagcctcaaggagcttagagtcgaatggttataatgcacagatttttgaacccttaaatgggtgtctcaaatcttgagtcagagctctgtaattagcaatcattttgcaccttagctctgcacagtgggtttagaactcttcaggagtaatcaatttaatagagaaaagagggcaaataaaaacacaaatggatagcacgtgcatagctatattgttagtgattagggaagatcagattgcagtcccagagggactgtgaagagtgtcatggatcagtgggactcatcgagagacgcttcctgcaggaagtaggcctcccttaatgtagcaaaagtttacattatttctgaacattaattatgtaattaattacataattaatttcattaatgtaaattattcatttacataactaatgtaaattaaagtttacattaactacatttaattaatgtaaattaaagtttacattaattccattatctcttgcctgtctttagggagaactgctttatttatttattaaaattttattttatttcaaattgagggggtacatgggcatgcttgttacgtgggtacattgtatactgggcttctagtgtacacattacccagagagtgaacatcatacctgatgggtacattttcaacccttgctccctgcaagtccctgcccacccactttggaggccacgtgtccactgtttccatcttcatgtccatgtggactcactgttttgcctccacttacaagtgagaacacgcagttttgattttctgtctctgagttagttccttaggataatggcctccagctccatccatgtcactgcaaaggacatgatctcatgcttttgtatggctgttttttttgttttttttttgaagagatagtctcactatgtcgatgaggatgaagtgcagcggcatgatcatagctcactgcagcctcgaattcctgggctcaagagatcatcccaccttagcctcctgagtagctgggatgatagatgtacaccacaactggctaatgaaaaaaaaaaaaaattggctgggcgcagtggctcacgcctgtaatcccagcactttgggaggccgaggcgggtggatcatgaggtcaggagatcaagaccatcctggctaacacggtgaaaccccgtctctactaaaaatacaaaaattagctgggcatggtggcgggcgcctgtagtcctggctacttgggaggctgaggcaagagaatcgcttgaacccgggaggcggaggttgcagtgagctgagattggtccactgcaatccagcctgggtgacagagcaagactgtctcaaaaaaaaaaaaaaaatagcaatgtggttttaggatgctgcccaggctggtctcaaattcctggccgcaagcaatcctcctgcgtcagcctcccgaagtgttgggattacaggtgtgatccactgcacctagccaagaactgctttccaaatgtctaccatgcagagtcagggtcattgtctccgtgagtaggaagtttgatgttttggcttgccttcatgcctttgattttctcatacttttgagactccatattttcacactttattttcccttctgcaggtgtgttggcaacacctctcgatttagctcatccctgcattttatctgttgctttttattcccccttaaagaacattaagatgagagctaaggccagagccagtgctggtgtcaggcctcccttcctggggcctgtgggtcacatgtcacaatttgtggcctagagcatttggttgtgttttcaatccatgcacctgtgttcttctgggagctgagatttgctaagattcgctacagtgaaagttttatctaagtaaacatctctcacctcttttggggacttttcatctgtggaatgagtgaaacggtccaaaggtgatcaagtacgcaagacagcctcctctctctaggacctggatcttcctcgctcctcattctcatgaaccattagtgggttttttttcttctttctcttaggacatggtcacagttgtgtgcagcagtgaagctggacataagagagcacagccaaactggggctgtggggtgtttcctctcacctgttcttcacctgttcttgcccactcagagcattgtggcccctggcttttattactgcttctttagttgcctgagatgcagtcttcattgggaggagcttgaaaagaactcactagcaggacctagtgcacagcaggcatttaataatgatttgtcttcggctctctctgcaaccttgtgagtggcattgcaccctgcagcctgctgttacacacagagtcagattagctatggctagtcacggctagtcacggctggtcatggctagctagtcacggctggtcatggctagtcatggctagtcacagctggtcatggctagtcacagctagttacagctagtcagggctagtcacagctggtcatggctagtcacagctagttacggctagtcacggctcatcacggctccttgtggctagtcacggctagtcacggctagtcatggctagtcatggcttgtcacggcttgtcatggctcatcacggcttgtcccggctcgtcccatgacgggattctctgggcatcattcttctcctgggacttggtgtcctcatccttcctgtgggagcgaggaggctgcctccctcacgggtggctgtgaggaattataaaccaataaagtgactgcttagcatacggctgaatgtgaagggcaatagaaatgcttaatttcatttatttgctagtagttgggtggccacgtgaatgttgctgtggagaccataactcctgaattccccaacacttacctatgctgttgtttttaaatgaagctttacacttaaatcttgtgattttttttaaaattagaaaagtagcaggaagggtcacagcttgctctccatctcagccttttcataggaaactgtgagctgctacagtccccacctaggagcatctactgaccagttactctcacctgatccctctcttcacccaaggtcatacgtcttccatctatccatccacccgtccacccatccgtccatctgtccacccacctgtctgtccacccacccgtctgtctgcccacccatctgtccatctgtccacctgtctgtccacctgtccacccgtccatctgtccacccacccgtctgtccacccacccgtccgtccatctgtccacccacccatctgcccacctgtctgtctgcctgtctctccgtccacctgtccacccgtccgtccatctgtccatccactctgtccacctgtctgtccatccacccatctacccgtctgtccatttgtccacccactttgtccacctgtctgtccatccacacgtccgtccatctgtccacccacccgtctgtccatccacctgtccgtccatctgtccactcccccatctgcccacctgtctgtccgtccacccgtccacccatccgtccatctgtccacccactctgtccacctgtctgttcactcatccacctgtccatccatctgtccacccacccatctgtccacccacccatctatccacctgtctgttcctccatccagatacactgcatttccaactcatgagttgaatgggccccatgtgagtagatcagaactgttgattttctagtgaacctttagaattgagaggatggagacgtgatggcagattctgtgcagctgatgaggtgaagggggaagtggcaaagggaacatttgcagcagtgatggtggaggctttagcaattccgtgctggtgcccagcctcaggcagcacacagctgtgagatgacagtcaagccagggggcaacaacagcactgcttagaaaaatgggtcttgattctaagccctcattggaggaatcctggaatcccacaccccagcaagtccctctcttccctgagcaggtcctcaggttgcttccgtgtctccaccacggtctttgaagcccttctctgggctgtgtgtgcttctctgcccaccacccttacggctgactctggtggccatcgctcccacagctgaagctgctgcacctgctgcggctcgtatggcttaggtggagacagcccgtgccttactcctggccacggcaactttgttctggcagttctttacagagttcttagtatcacaactttttttttttttttttaattaagcacacattctcagttcattttctttaatggctcttctattcccaacagcaatcagccagtgtcttttgatgatcttcccagtgctggggtcccctctcccaagacgacatgaagctagaccccatggggactctagctggacatgctgggattcctgaagtgggcacacaggctaactctctctctgggacttttgcttcagagggaaaagacaactggattattgtggccatatcttttctcttttttaatgtcagttctgggatacatgtgcagagcatgcgggtttgttacataggtatacatgtgccatggtggtttgctgcacccatcaacctgtcatctgggttttaagccccacatgcattcggtatttgacctaatgctatccctcctcgacaggccccggtgtgtgatgttcccctccctgggtccatgtgttctcattgttcaactcccacttacgagtgaggacatgcagtgtttggttttctgttcctgtgttagtttgctgagaattacggcttccagcttcatccacgtccctgcaaaggacatgagctcattcttttttatggcttcatagtattccatggtgtatatgtgtattgtggccatatcttttctaaatcaaatgcatcatcttcctcccacttttcttgttgttggaaatggtatttcatctctcttgcccagctcatatgcctgaaaatcatccttgccatctctgcacatcagtttagtctccaagcctagccgattgagtgccaacagctctgaaattgatccccaatttccatcccctcctttacctctcccatcactttctaaaaacagcactattgacatattttacatatgataaaacccaccctattcaagtgcacagttcaatattttttggtaaatttactgagtggtgcagccatcaccataaatcagtttcagaacattttcatcatcccaatgaagatcccatttacaattaatccctgttcctacccccagtttcaggcaaccactaagctactttctatctacagatttgccttctgagcatttcatatagatgaaatcacacactacgtgatctgtcatgtctggtttctttcagttagcatgatgcttttgagattcatttgtgttgtgatgtctatcagtatatcagtatttcatccctttttattgcccagtaatactccatttttggatacaccgcattttgtccatccatcagctgaggcacatttcacctctttttggctatttataaataatgccactatgaacttttgtgtgcaagtctttgtgtgaatgtgaacatatgcttttatttctcttgggatagatactaaggaatgaagttgatgacggtacagtgatattatgtttaactttttgagaaactgccaaactgttttccaacacagcacaccatattacattcccaccagcaacgcatgagggttcccgtttctccacatcctcaacaatgttgtcattgcctgtctttttgatgatagtcgttctagtgggtatgaagtggtgtcctttgtatttttaattttcatttctctaatgacgaatgatgtggagcctcatttcatgtgcttattagccacacacagagcttctttgatgaaatatctgtccatgtctctcacccattttttgatgaggttgtttgttttctaattatggaattgtaaggccctcccgtcccatcactttttttttttttttgagagagggtctcactctctcgtccaggctggagtgcagtggccccagcatggctcactgcggcctcgacctcctgggctcaagtgatcctcctacctcaacctctcaagtagttgggactacaggtgcatgccaccacacctggctaattttttagttttgtggagacagggttctcactatgttgtccaggctggtctcaaactcctgggctcaagcaattctcctgcctgtaatttgagtgctgttttaaaaattttaaataaaaatgtttccaggaactcccccccgccaccccccagcaagaaaatgatattctagtctggttctcttttgaattcattggaacagtcaccaatcatataggtagtgggtttttttattcgttattttaacttttatttttggttcggggtacatgtgcaggtttgttatataggtaaccttgtgtcacgagggtttgttgtaccgataatcttgtcacccaggtactaagcctagtacccaatacttattttttctgatcttctccctcctcccatcctctaccctcaattaggcccagttgtattttattctaagttctggacttccacagctttttagctttttatgccccacctgctacccacatcttccacctcagatcctaagctgtgtgtggttcttgcttggggaccaaggaagggtttatgtttttccctggcactctccttggctttgcctttaaaaaaaaaaaagagagagagagagagatgaggcttctatctgttgtccagggagcacagtggtgcaaacatagctcactgtagccttgaactcctggctccctctcactctgttgcccaggctggagtgcagtggcatgatctcggctcactgcaacctctgcctctggggttcaagtgattctcctgcctcatcctcccaagtaactgggactacaggtgcgcaccacacctggtgaatttttgtatttttctttttttttttgagacagtgtctcactctgtcgcccaggctggagtgcagtggcacgatcttggctcactgcaagctccacctcccaggttcacgccattctccggcctcagcctcctgagcagctgggactacaggtgcctgccaccacgctgggctaatttttttttttttttttgtatttttagtagggacggggtttcaccatgttagccaggacggtctcgatctcctggcctcgtgatccacccgcctcagcctccaaagtgttgggattacaggcgtgagccaccgcgccaggccaatttttgcatttttagtagagacagagtttcaccatgttggccaggctggtcttgaactcctgacctcaagtgatcctcctacctcagcctcccaaagtgtcgggattacaggtgtgagccaccgtgcccagcctgctttgttgtatcctggctttggctaggcatgcagctgtgtgtgtgtgcaatgtgtgcatgttgctcacattgtgtgtgtgtgtgtgtgtgtgtctggatgctttgtgggcacacacatcgtttaccctctagcttcttgtgattcctctctgacactgaaacttgctttaagttccttttaatctttttctcataagaatattaaattaagaatattaaatattaatattaaattctgtcttagaaaacagaattagaggctggtcatggtggctgatgcctgtaatcccagcactttgggaggctgaggtgcggggaggatcacttgaggccaagtgtttgagactatcctgggcaacatagcaagatgctgtctgtataaaaaaatataaaataattagccaggtatggtggtgcatgcccgaagcccagcaattagagttgccagctgcttgggaggctgaagcaggaggatcacttgagcccaggagttcaaggctatagtgagttacacttgtgccactgtactccagcctgggcaacagagtgagatcctgtctcaaacaaaagtaaaaagaaaacagaattagaattagcaactccccccaaagaattgttatgctttttaatattttggtgttaaaatctaatctttttttcctgatacatatatacttttcttttggttttactgagttattatcatattgcatatactttactttttaacttaacactaatatatgatcaatatctttgcattccattattcttttatgagcatttgtaagggctgcaaggtattccactgtctgactagactgtaagttgtttatttactttttttaagaaatggggtctcactatgttggccagactggagtgcagtggcaccatgatagctcactgcagcctcgaacccctgggttcaaaacatcctccagcctcagcctcctgagtagctgggaccacaggtgtgtgccactgtgcctggcttagactgtgagttattaaacccatccccactcttgtgcgtttaggctgtttttctccccttcgctattataaacagagctacactggatgctgtgatcccttttcaaagcaggttacttctgtggaaggggcagcacagcccaaggttgtgagcatctggaacccaaggtcagtgggctgaggacacattgtctgatcctcctcgctctttttaatctttttaaagtcttttaaaatcttttttaagttttctcccccaaccccaaaacaaaataaaattaacaaccaaaaaaaaatgtatcactctgactacacaaatttggttcatatcttttctctctatctacctttatcatctgaacttttaatttcagactgaaatcaagccttggaatttagcgtggaaggaatttataaggctaaaatgattaatgattgaaatgatatttcaagagtggaaaccctttctcagcttgcaggataacaaccctcctcttataccacaataatgaccaggcacacagattcacgttaccagcttgccgatgactctctggtggcccccgcatgatcatacggtcctcagaacaccagaagatcatatgcaaatattgtctgcatattcatcaagataccacgtggccagtgtaagctgctttaattattcttcaaggagaaacacagccgtctctagcacacgcacttcagtggctctgtcggcatgttggtgcctgaactgatatggaaattatttcgaaagcaaaatattgaagaggagtgaaatctgctgtactgtacagtcaacttagcaattagaagttgccagccttttttttttttttgaacagtcttgctctgttgcccaggctggagttcaatgatgccatgttggctcactgcaacttctgcctcctgggttcagatgatcctcccctcagcctcccaagtagctgggactaccaagcatgcaccaccacatctagctttttttttttttgtattttttgtaaagatgaggtctcgttatattgcctgggctggtcttcaactcctgggctcaaacagtccacccaccttggccttccaaagtgctgggattatagttgtgagccaccgcacctggctggttttttatttctgatttatactttcagactttcaaaaacacaatgatataatatattttagctataaaatttatgatctattcacccctgagttataaataatgggaaagctaaactgcattctctgaaatataaaagtcccgtgaggcattcccaaagaagttatgtccatttaataattaagcaacaaggaatatggaataaaaatttcattcttagccaggtaatggactttagctttctttgcactttgtactcatggatacaccagaaagatatgtttttcacccagggatatcaacggaatcaataaattgatgttcatagaagctcttggtggccgggtgtggtggctcacacctgtaatcccagcactttgggaggccgaggtgggcagatcacttgaggtcaggagttcaagactggtctggccaacatggtgaaaccccgtctctactaaaaatacaaaaattagtcaggcatggtggtgcatgcctgtagtcccagctacttgggaggctgagggatgagaatcacttgaacccgagaggtgaaggttgcaataagctgagatcttaccactgcactccagcctggggaacagagtgaggctccgtcttaaaaaaaaaaaaaaaaaaaaaaactcttggcttttataagccagtatataattttttcattcttaaaatgagtgtcttttcccacctaaatcttgaagtaatagtgttaacatcctcaaatgtgaagaagaaaaacatgtatatttataatctatatcatttatctatctatgagtaatgagtaaaggtttcagttgcaacactgaaattcctcagtctaatagagaatcaaattatagctacaggctgctaattcatagaaagaaaacccttgaaacaacaagaattccaaaagcccaaggtagatctgaaaaagccaccgttaaaactagaattcgggagtatcttatgtacaacgttgaatttcccaaagaaaactctcataaactgacaacaatgaccaacccatttaagggccctggagaatggccagaagcaggcagagactggaaggggttcgaagatctaatccttaaaagaagggttctagggccctccttccagtctgctgagcactgtgactagagcacaagaaaaaagccagtcgtagggtttgaggcattccatggtgaagttcagggctgtcaagagtagctggagagggggaaggagaatccaggaaaggagagagccacactggggcagccctgaaatccactaaaatttccctcaaatctggctgatgagttgaactctgaacacccagaagagctgcaggaagtcgagagaaggcaggaactgcatggtgaaggagttgagcagagactgcaagtcctgtcaagtgcacggagcagagttggagtctgagttccaagttagaggggactggcaaagcggttaggctttccattgaagctgcagaagggctgcgcctcggggataaagaacagtcccaggactaagggattttccttagatctcagggcaaaagctagttagaaccactcaaagaaagcatgaaaccaagcctcctcaagttcgaggtgacccatcagtaacttaactgcctgctagaacaaaaatcaatactcctcaaggaagggaatagaatctagcatctctatgatgtagcatctacaatattcaatatacagttacaatttcttgaatatgaaaagaaacaggaaaatgtgattccgagtcagtagaaaaatcagttaatagaaagtgacccccaaatgagtcagaggttggaattcagacaagaactttaaatacgctactgtaaatatgtttaaggatttaaagggggaaaaaaacagagaactggaaacacacacacacacccacacacatatgcaatttttggatcagctgcatcagcttaacagcagattggaggcagctgaagcaaaggttggcgaacttaataaaggagcaatagaaatgattccgtctgtaaagaggtaaaaatgtaaataatgaacagagtttcaataacctataagacaatatcaagcactgtaataacaaacatgtaattggtatcccagaaggagaggaaaaagagagaacagggcagaaaaaaatatttgactaagtagtggctgagaatcccccaaatttggtaaaaaacttacagatcaatttacagatcctagaaattcagcaaaccctaaccaggataaatacaaaaagtaacacatatagaaatattatagtcaaattactgaaaaccagaggcaaagaaaaaatcttcaaagaactcagagaaaaaaagacacattacatacaggagactgtccatatgaattactgctgacctctcatcagaaacaaggaaggccaaaaagcaatgaatgacatcctcaaagggctgaaagaaaaataactgtcaatcaggaattctacgtctagctaaacgattcttcaaacacaaaagtgaaacaaagacattttcagataagcagaatctgagaatttgttgccaggagaccctcactataagaaacactaaaagaaatgacccagttagaaacttgcctctaaaggaaaaaaaataaagagccccagacatgacaaaactgggtaaatataaaaaacttgacattttcactgaaagacaacagattgtttcaagtaaaattgatgaaattgttttgtggattttataatgcatgtagatgtaaaatatatcaaattagtagcacaaaggaggaaggtaagatggagaggttgcaagtctacattttaggtgaagcggcacaatgttaattctaagtagcctatgaaatgttaaagattcatattataggccaggtatggtggtttcatgccataatcccagcactttggaaggcggaggcgggaagacagcttgagctcaggagtttgagaccagcctgggcaacacagggaaaccttgtctctacttaaaaaaaaaaaaaattagccaggtgtggtggtgtgcacctgtagtcccagctactagggaggctgaggagagaggatcatttgagcctgggagatggaggctgccgtgtgccataatagcgccactgcactctagcccaggcaacagagtgagcccctgcctcaaaaaaaaaatccatattataatcatcagagctaaaaagtcaacagagagatgaaactggaatactgaaaagttattcaattaacaaaaaaaggcatgagagacagaagaatgaaagagagtagagatagaaaacagacccatactagcaacaacatgaaactcaaaaacctgtgttaagtgaaaaaagccaaacccaaaagagtacatgctgtacggattctatgaattaaaaacccttccagatcagtccacactaacccatgctgatagaaatcagaacagtagtttcttatgagaggtggggattgcctgggaaaaggtagataaccttcaagagggacaggaatttatagatgttgatcgaggtggtggcctacgcagagtacacgtttgtcaaaattcatagaacttaacaattaaaatgtgtgcgtttcatcttatgtatatacattttacataaacatcaatttttgaaagcttcttaaaaactcttgcagagcctccggttataaactttaatcaacagagggcgctcggagcccaccaaacacgctttgggcccccagctacttagaaatgcaaatcagagcagctctgggctcccccgtctccgaggtggatcgcgcagctccccaacactccccctcgacaccccaccttccccacccgcggcctcgccggctcgtttcaccacacgctgctttttggctgataagcggctcgtggccaatggcgatgatgtgtttcgcggcacctacgcgaaatacagatgcgggtgggagctggcgcgtgctgcctggaggtgtacctgccccctaaggtcccctattgataggatcgcttttaaattggaagtgggaacgtaacggaaacgtccactctgttcttgccatcttccttttgacctttttacctcgctttggtggctgtgaaatattcccgcgcaggagctggagcggggaggagtggggcagagcacgggaggcacagaagaaattgtccccgaggaaggcagagtgggggcgtggccccaggcttccagaaccccgaacctttgtcttcttgccccctcctgcgtcgtccacagctcagaaggaagtcagcgaccagaaagccctgaacgtccttcgcgccctcgcccacccccgggctgggtctccccgcgggcgcggagatgccgttacaccccacgtgatccctgcgcccggccagtccttccagaggcgtctcgcggggtgttaattaaaggtcacaacaaaacagacctgctggctcaccagaagaaatgtcctcccgtgaaatgaaaaatgacaccccagagcagccacgtgtggagcctggcatacgccggcttcctgcgctcctgggcgctgcgccgggggactggggcggggggcgatcggagagggagcgatgacggggtgctccggagaccccgcggggcccaggcgcaggaagaaacgggcggcggggggcgaggggcccgatcccacgcaaggagaggccaaggccagctcgcgccacaccccctctccaggccagagtcgtccgcgtgcagcgcggcgaagccctcagtttcccctgcccggcagcggcccgctgggtcaccaggctcacctgtcccagccccgggcggcttagtccatcacagaccggggctcgggcgggcgggggaccaagggccctagtcctgcggctgcggtcggggagggtggccccccggccggcccggggtcggtagggcaattccagaaaaggtttgcccggcagctctccgagaacaaagggcggggggaggacccggcatgtttgtggacttgtttgtgactcaatcccttttgcacggcgtttcacagacagacctgcaagccttgtcaggaagagaaagaacttgggggcgggggaggctggggcaccgcatttccgtccagccacgctcgctcgcgcggcccccgggctccaggctcgcgcagcggcgtttcattagagccccgggcccgggccgcgcgccaggaacttccccgcacgcggcgagatcgacgatcccccgcccccagccccagcccggctccaggcctcgcaatgtcaggcacgagcgccgccacataaaatggatcccggccggcgcggcgagggcggcaggttcccgaggctcctccgcgctgcgcccgggcgcacacgcgcgctgtgaccgccgaccgctcccgggccacgcggagccgcccctctcccggccctcgcgcaactgtcaggcgaaacgggccggcggatattggctcggcgacacgccgaggctcctccccgagtctggatctttatattttgggagaatttctttgaactcagttaccaagctcggtgaaggagacaagttcccacagctgactcggctcggctctcccaccttcccggcagcggccgcgagccctgattgtatccctcgctttcctcgtgggggagcacggactgacttggctgaagaaaatgccagttctgtggatgtggccgtgacaagaggacgtgcggctggaagaggcagaaggggacgaggaaaagcatgctttgaagagaagaataaaccagcgaccccaaccctttctgcaaattggtgctattacttgtgggatccatttgctttcattccctcccaccccaccgctgaagaaaccttgccctgagggctgagagccagccccctgcagccgggggacgcttctgggttggaggaccttctggatgtagcgtcggtggaacctttagatactctcctctggaaaagccaccatgaattcggtagctgggaataaagagaggcttgcggtctccaccaggggcaagaaatacggggtaagttgtgacggtacgacgcggagacgcgttaccagacccatctcggcggaggtccccctttccccgggatcgtgcggccccggccccgagctctcccccgctgcagaggcgcccccggggctggcggggttgtgagtgcgcggaggcgggtcggccgcggggacgcccgcacgctcgcctcgctctcggaattttttcagccctctcgttccttcctttccacgcacccgtaacttttgccgcattcctgcacttctaggcagagtgaagccgaaggggagggtttcccatgaatgctgggcagtacctcggatcgtttagctggagccgtgagagcctctcgtttacctgcaggatccggagagttggaccccgtatgaataaaaatcctgaaatcacagccctccccctaccccccccatagggtcttccaggattttgttcccgggatcttgctgggataggtgccggcttcaaaagcgtggggcgctgaacctatggatcccccccgccttgcagaagccgtggaaacggccccgagcgagtccccttcctgaccccaggaggaggccaccggggaccagcgcaggggtcacctgggcggtggggactcacttaaggacaattaacgagacagacggagggcaatttggccgcagggcttggagaggtccccaaccgactcccgtgggcggttcgagcgggtacttggtggcgcacgtatgacccagctcctgggcgctgcagcccgccgccttgcagcccctgacaccggcgtgtcttccccgcaggtgaatgaagtctgctcgcccaccaagcccgcagcgcccttctccccggaaagctggtaccggaaagcatacgaggagtcgcgcgccggcagccggcccactcctgagggcgcgggctcagcgctcggctcctcggggaccccgtctcccggctcgggcacctcgtccccgagctcgttcaccggctccccgggacccgcctcccccggcatcggcactagttcgccgggctccttgggcggctctccgggcttcggcacaggctccccgggctccggcagcggcggcggctcctcccccggctcggaccgcggcgtctggtgcgagaactgcaacgcccgcctggtggagctcaagaggcaggccctgaggttgctcctcccggggcccttcccgggcaaggtgagcgccgcgcggggctggctggggaggcgccgggagggcggggccgggccgccacccacagcagctgctcagcccgccgcgaccttgcgcgccggctccacgcgagagcccccggcggcgctggggatgctccacacctcacggggctctagcacgcggggcgacccatgccccttcctcagccaggccgcccggggggcaggaggaccgagtcccgagcgcgaaggggcgcccgtggccacaggcctcacggcccacgggggaggcccccaggtggtctctcctgccgccccctcccagctctccctggcggctgcaggctgcgctttcgatgtttctccccacccccacctgtgatcctttacaaaaatgtcagcgggagctgtaaaagcaagctgatgctcggagctggcatttcccactgcctgtttgtggtccatcctttccgcggttgcagaaacagaaacatactcgaaagccagcattttccccttctcagtctgtgtgtgtgtctgaggaagatccggaggcgggtggctcttcggagcagtgctccctcctggcctgctcctgcgccaagcacactggttcctccatagcaaccctgcccgcagtgtgtgactggcccgagcccccaggggatagcaatgcgattgtatttgcactgttgggtccaagtactatcaaatgatcatatttactcggccacttcaaagagtttttatcagtggttagagagcaatatcaaggaaatagagtggattgctgtagaggtttttgacactgttggttcaacgtcaatttctggtttattatttccgtgactttagaaatgaaatactgtgatttcgagtaggcgtttaggaatgactgcgtctgctggcccaacctgcgtatgcagatacacacgttgatgttttcataggcaagggttaaattcaacaaatgcccacagacgctgtgaaacttaaaatgggggaaatgaccaccaggagaattggttttatgaatgcagaacttatctcaagaataatgaactcgtggatggttgtcagtgtaccgtttttgtagtttgatacatctgccgtgacatcccaaggatacatctcaaggaatcaaaaagcttatttcgctcttgcgtgctagaccttccgatttaacaccgtttcttcattcacagatttatttgctctcgtgatccttcatcaatattcattgattttctactccatccgaggcactgtgtcaggcacagcaatgaaaataccaggtccattcatgcagtccttgtccacgtggagcttagattctagtggaggatacagataacaaccacaaaatgcacagttcacaatgtcttcacatttgtggagggaatgtagggtgctgtgaggttgttgaactggatgggagcatctgataaagatggaaggaccttggttcttaaagatctagtagctgatatttggcagtcctaatacgttacagcctaccaaattattttagacctttcttgaggacctattcttataataggcttattgtggctttgggtgttcctatatgcaaaggccgatcaaaatacactcttctcatttaaaaaaagaggaggggaaggaaaatctacagaggaaacaaatgttgaaactcatacgcatccatcatgttttatggagtcctgtgaccagctggaatcttgtttttatagaaacagcctggaacattcacttacagtgtcacgggaggcagctcaatatatttgccaattttatgtatgtgataaggtaaaactcttgttggtaaactgattgtattgtcagagtgaggtgatggccccagaagaaacactggatttgctgaacccccatgctctacaatgacttcgagtgatccaaggacatctagagaagacctggcagtcatgggggcagtcacaggggatcactttaagtgcatacgtgaatgtcacatagtaccacagtcgcctgagttttatatgtgaagcagcacagtaaagcgtgacatttggtgcaagggcatagacagggctcagccaggaagaaggatgctttgcatcagctcattgttagtaatgagatgtggggcctcaattttaactacaaaatttctgcaagcctttgtgaataataattgtgtgtgtgtgtgtgtgtgtgtgtgtgtgtggtgtgtgttttaagcatttgtaccttgcatttaggtacaatttccattatacctttagcatttgcaaccttatagccaaacagttgccatgttctctggtgtaccatggatggaggccatgtaacttggataagacttttcttcttcccggagcaatattaatgaacaaactgtggaccactgtagccctcaggcacagaaggagttaagtttcattagaacaagaggtgtcactgtgactccaacatgcagttcgctcagttcgctctgaagagtaagagtctggaagataaagacatgtttttgaggagtaattaacaaaaatcatctgtgtaatttgcttaagatgcttacctgcatttgggaaatattttcttaaatagagtgttaaattctactaggtggtattaaatgtctcctaggtagatatttaaaagtcaaaagcagaatagcacatccaggaaccttaatattttaggatggatttggttttggttcttcttcaccactgatttactttgtgacattgggtaaattagttttcctctctactttttaactttcctattaatatcctaaggaaaaaaatgaatgagactattaaaacgtcattaaaatgatccaaggtaaggtctgaaaagtgctttcattctttagagaaagatatgagggttgatgattattaatgagctaagattctgttagatttatgttttacagaatttaaggtttttcttataagatattactcctgtcagtttctaatttcatctgtatattttctaaacatgctgccatatgagttctcacactgtgcctgttggtaggtagcaagccctattgaatcccccgttctgtctttggaacagttggttaaggaggggaggtgaagtagtagagagcccattccgggtatctggttggttccaggagctagtgcctggctctggtggcctgagaagaaccatcttattctgagcactccaatggaggatagggcttcatggtagaaaatgacattatttgaacgtaacggagtgggtgatagtgttggctgaggtaggaaataggaggagacatggaattggatggagctcagagggaaggatgatcatgagtttggttttccatgcagcgagtctgagctttctggaaagagatggaggcagatttaataataaaacactttgtttttggctatctcaagactggcgtgtagaagtgacagctgtgagctcacatagctctgctgttgatactctgtattcatcctttccgatagcaacttacctggtgagtagacgtttgtgcttggtggcagattgtaaaacactcagattgacttttattaccttgatcagtacaaaaagtacttactgggtttatatcgtttctcttttggtgccggtgagtggaagtggtcggataaaagaatgtggacgtgtaaagtgttgagattttaagtgagaatggcccttttacccactgtagccttccagtgtgtgaatacaaaaccatttcatgtccaatggcaagagcatctttcctgctttgtacacagtcagggcactgagccagaaataggggccaaggaacgaattgctcaattttgggctagcctagatcattctgatatctgtgacagaacttttgaatggactgggcaagtcctacgaaacaacagcccaacgaaattccctggagtaagcagtaaagctccaggttggcaaaaggttatcagacatctgttcatttccatatcaataaaagaaaatcttttatgtaaaaaaaaaaaagtgcagaactatgttcctatctgattgtctctcagtcagatattctgagtccatttatgccccagaaatatcaggaagattagccagacatactgagaagggtggccaggaatcacagagatgaaagaaaggaatgcgtcataggggttaaaaacgccaaacgtggactctaaatagccggagaccaagtaagtctagacttgaggagatatagatatccccacatgcatatttctgtattttgccagctccaaaagaggggtatggaaaaataactagacgcaaaaagtcccccaaaagccatcataaaacattttatagataggataaaacagacattgcatttcgagtacttattaattataagggacttctagctgaaatcttctctttcttctaagaacatgtggctattttcaaaaagcttcatttgagtctttctcatatcagaagtattttagataaaggagcagttagtagataatagcagtcatgaaaaagtcctacagcatttatcatttgaaaatttctgaaacattttgggagtttataaaaacattcccaggagagacatgtgagcagtaatctctttttaaggcttagcaagctgtggaataatggcagttcattctaccagactattaattgtgaagcaacatggtcagtttttatagtgacttaattcactttgcaaaaatccctggcctgcaataattccttccacacccattgcagataggattactacattagaaatgtgatttttaaatggctgaggctggtagtttgtcagcatttggaaggattaagtcaattaaaatggaggcaacatcagttgccatttgttatttggcattatatcacagattgtaccatgagtgggccaacaatagcgatgatagtaataataataatatgtaataaatggctaacaacgattgtcctacataccacgaactacactgaaacacacacacacataatctcatatattaaaatgaagatgaacgtgattttttcttttttaccctggaattccaagtgcttgatgtggttaagatcatagaaggaagcatgaagaaaaaatatgcaaggaacagagaaatccaatcacactttcccctagaagctgttaagggtccctgtgagtagaactgactgagtgagaggcaccggctcgagatggttattatttttcctgggctcacagatgagaattttacttccagtgagtggggaggttgggggaaagtatgtgagactgtcaggttctgagttgaggaattgtcttggctggaatgcaaggggcggggggaaggaacctccttatatttacgtgcacccattggagaccctgttgtcatcccttcctgaacagaaaaccctgcccgagggccccgtcctgaccttctgcgaggaagagttcttcagccggccatttcagtgccccatcggcagggcggccagacctctgctctgttttgtcctcaaaaagattgcaaattggctggtgtctgggagggttcttggtcattttgcaggaatacaagacaaatttcctttttaccactctctgcagtcacaagctattcatcagcatcctttctttcctgtttctcgtctatggtgttattgtggcgaaggagcactgttgagaatgtgctcccaatcgctcttttatacctatagatgcacccatcagaaatatcttttttttttttttttttttttttttttgagacggagtctcgctctgttgcccaggctggagtacagtggcgtgatctcggctcactgcaacctctgcctcctggattcaagcaattctcctgcctcagcctcccgagtagctgggactacaggcgcccgccaccacgcccagctaatttttgtatttttagtagagatggggtttcaccatattggtcaggctagtctctatctcttgaccttgtgatccacccgccttggcctcccaaagtgctgggattacaggcagaaatatcttattttaaagtacattcgtgtagatgcaaaaggactggggatacacctgtattcctaatgtacttttgaaatatttgtcaagatatcaactcagtttgtatccatcattggcttaccattgcctttggaactgctccagagcctatctgagaaaattggaaatgagtgattgttaaaaagatgtttgtccacctccaggtctcaaagaactcacctatgttttcttctagtatttaaatagtgtcctttttaatatttagatctctaatccattgagagattattttggtgcaaaatgaaagatatagatcaaatttcatctttctctaaatgtctatccagttgtccccactttattaaaacattcttcttacttgcagacttcttcttgtgaaaaaaagaatttatctttctcacattaattgaagataccaccattgtcataaatcaaattttcagttgtatctggacctattacaggatcttctagaatgttctcactctgttgtccaggctgggttacagtggcacaatctcggctcactgcaacctccgcctcccaagttcaagcagttctcccgcctcagtctcacaagtagctggaaatacaggcacggaccaccatgcccagctaatttttgtattttcagtagaaatggggtttcaccatgttgtccaggctggtcttgaactcctgacctcaagtgatctgcctgccttggcctcccaaagtgctgggattccaggtgtgagccactgcgcttggcccacactattttaattatggaagctctgtagcatgttttcatgtttggcagggctagctctctctccctcaaatagtgcctttcttttctaggagtttccttgcctaactccaatttttttttttgttaggaccgtgttgaatgtatacattaacctgggggaatagttggcatctttatggtgttgaatctttcccaagaacatggaataccttttcatttgaacaagtctactttttagcaatttttaagagtttcttcatataggctttgcacatttcttgttaaactttttcttaggtattatagcttttgttgctattgtaaatggagtcttcactttcattatctcttttaattgataattatttatgtgaaggatattgatctacatgttttatatcccgtcgccttattaaattctactatattcactgatttttaaaaaattggtactcttggattttcaaaaaattttgtcttcttcaaatacagatatcattactctcttcctttgctatttttatgcctctaagtgttttctcttttttgttacattggctggtactcctgacacaatgttacataatagcgatatagtgggcatgtgtatatatttttttctattaagatgttggcttttggactgagatctgtctatattttttaaagttaagtaaatatccatcaattcctactttagtgttttattaggaatgggtattatattttgccaaatgtcttttcagtatttagagagagaatcatgcaatttttctccttagatttgttaatattgtgagttattattattgattttctaatagtgaaccatccttgtattcccataataaaccccacttggccacagtgcattttgaaagatatgcttctggatccaatttgctaatatttcatttattgtttttgctttgatattcatatgccaatgaacatttttgattcctgtttatgtgccagttctagtactatgccacattataatccaaataggaaaaatactaaaattcctgccctggagcaactcacagtctagtgtcagagacaggcaaggaacgtggcgaagcgtaagcgttccagccacaggaaacggcaggcataggccaggaaggggtgatgcgtgccccctacatatggggaactgaagtcgcacatggtcaccatacacagtatttgtatgagtgcgtgacaggctggaaaggaggcagatggaggatgaaaggccttgtaggctataggctggactttatcctgtaggacgtgggcagccattggagggcactcatgaagggagtgaaatgatcagatatgcatttaagaaagattgctggccaggcacggtggctcacgcctgtaatcccagaactttgggaggccaagacgggtggatcacctgaggtcaggagttcgagaccagcctggccaacatggtgaaaccccgtctctactaaaaatacaaaaattagccgggcgtggtggcccacacctgtaatctcagctactcggggctgaggcaggagaatcgcttgagcccgggaggcggaggttgtagtgagccaagatgatgccactgcactccagcgtgggtgacggtgcgagactccatctttaaaaaaaaaataaagattgctgtgagaatgagcaagaagatgggttggaagagtggtgtcaccgagaccagttgggaggccccttgcagtggcttgagtgaagaatgacacagactgaactagggtagtacagagggaagggagaggcagctccggcctgacacatatcatatgtagaaaacccgccatggggagctgctgagatacggggccagagggagaaaagatgatgcattctcccaggtttctggccagggaaagtgtgtgggtggtgctgccagttatggagatgaagaatacaggcagagaaggggttttgttattgtgagcccagtgttcgaggatggctgtggatgttaaattgattggggtctctagagcttgaggtggaatggtccaatgggctcctgttggcgctctagagcggcttctgaggtggagatatggatctgggggatgtcagcgtagagaaggtgatggaatccacagacggcatgagctctccacagatgtgtggggtgagacgacagacagctgaacatgaagtggtggagaccattgacatcgaagggaccagtggcctgaggagctaagaagacagaccaagaaggagggaccagaaaagagggatgaaaaaccaggagaagacagtgtcatgggaactgaggaaggagtgagcttcagggcataggggtgacaaaaggtctgatgccctggagaggtcaaggaagtaaggactgaggttttctttgaactggcaaggaggaggtcattggatgtctttgttggaagaatttctggtgccctggagaaagccaatggcattgtgtccaggaatagattgagaggtgaggacatctcaggcagcatttgagttgctgaggacactgagatacaagagatccacttcttgaggctcttattatcttaaaatgaagaactacaatcaacagacttgcgtgcaaaaccaggctccgtcacttagggtgtgaccttgggcaagccttggtctttctaaacgtggttattctcatctctacagtgggagtcatgacagagccccaccaggaggatcgtgaggattaggtgaaattgtgagatgctagtcaaccatcgctttctgttattattccagtgactttccacaggaagttgaattttatataagattcctaccctccttccttccctccttccttccctctttccttccttttttccttccttccttccatctgacacgaaaatggagaaacagcagtcagagaaaatgaaagcattcagtgcgtctttgtttcttcacctccaagtggataaagcatctcattcttatttattcatttgtagagttgtcaccacagaaagtttaagggagctcagtggatgtaaatagcgactcctttgggttgaggtgccatgaatatggattgagagttttttgtcacagatggaaatcccttctttaagcccggcccctctcgtagcccctccagggagacttgcagatgtggcatttggcatttcggctccggggaatgagggagagcagatttcctccagtgactgcgcatgcgatgtgcagatctgagccgcaccaggaatttgggcttatctgccttccaatccagctttatctgtctcagacggttttctttgcagttgtactttgctgatcctatcacatcgattccaaccagaccccatgggaagtctgggaataaagaagtcaccctcccccaccaagcaggatatcctgcacatacatcagctctcagggctggaggtgaccgtggaggagagggatcctgtgagctctaatacaaaaaaccgagacattctgaacgttgctatagaggttagcaaagcagaaggctctgagggtagagtaagtattattaattttttaaatatgcagaacgataaatatgtcttaagtgttatagaccaggttacagctgagggactattttgattttccttttctacttattggagtttacgttcaatactgttgccaaccacaaaaagttattggaacaaattttagctctccacacagcatggttctaaaatctttgatggttcttacgtgtaaactttctttttatataattgtttttttttttgcttgaaagcatgagctgcaaataataaattaaaatccgcttttctatcacaggggtgacaaatagaaacttttattttgatatgtccttatctaagtgatgtctgaggtctgtatatgctaattcaggattttttttctgagctaacctaggaaccgatagaacttgagatttttctgcagtgtaattttgtctttgagttggcagtgatgagcagctacacttccccatgaaactctatcatcgtatttagagtggttgctttctttggggttataatcactacttcccaacccttcctccacctaactggtggcttcacacaagaatgggagactcacctattaactgattagaagccagcaataacaaccagcaccaaaagctgtcgagctatctaaccaaatggttgtacagaaaataaacagctgaattcaggcaaacaactggaagcagccaccattgtttaaaaaaaaaaatcacctgcccagttcagttgtgtaactttgcacagcagggagtctcagtcctaagcaggtggcagagtgtcttccccatggtaccatggctgggaattagagcatcaggtgtcctttaccaagacaggcagcgtggtgatgggggctgagggatagatgggaggaggatagaaaggagaggaataagaggggaggaggaggaggacggatgagagagagggcgaggaaacaaagaaatgggtggtatacgcatccaaggttgtctacaatcccagatatttaggtgaaaaaggactgtccttggatctggggacagaggtgcagtcctgcttccagcactgataagcattatgatcttgggagaatcacctagctggcctgtgcttgatttttcttttgtaatctaagagcatggtagtcggtgggctctaagcttctcccaagcctgtgagtctctgtgaagctgaggctttgggagtccactccgtgaacccagattccacagggatgtgcctggcaaaatccaagtgggtttctggctgaagctgttctgtgggctgccatgtttgtgggacatctcatctgcagccgccgcagcgacctccttgtccgtccagccaaggggagggaccggaagccaagcggaggggccggtagcgccgtcgttgctgatgcttctgcttttggaattcggatcataaactgacagggttcttcctgtttcttaataaagctatttgttttactgtctaatgtgtttctaagcagaaatagacaaacaaaaggacaattgattctagaagagagatttagtatggagtatttgaagaaaagtattgccttagaaataaggatgttttgtagttaattttacattaaaagttctgccatattgattaggatttagaaataacatacgaagagttcttcctgagtagcagtataggaacaccagaactctataaacattttattcatcattcttcatctgatttttttccaaaatctttttgctccctttgatttctctctttttttctgctctttcaaatgcctagacagagccatattgattaggccagtatttacatatcacatgcccctgacgtgggtttaatgccccgtagtgtttgatgctgtggtctgggaaagaatggaacaggtagctgcccgctgagtcaacgaggcccatgcagttatcatcgatttttatttttctctttaatcatttagccaaggttgcctctttaaaatatctacttcctgggggatgtttccctgactcttatttcaaatctaatactttgtatttgagtctaaacacaattcagggaatatagctattaaaagcagaacttgattttgtttaactagtccagagcgcgtgatggctttggagcagagtggagaacaggcacagaggagcacgagccccaggaacaccacttggtgcccctccctcgtccttccaccgagctctctgcacgtatcttaccagggcgtgaatggagcattctgcagccagacacatccaacccacagcaaaccctccatgcaagcttgcctgtgtcctcagacattctaccctttatttctcctcttgttctttgcccctaagtttgtccatgcactcgactttctaacgggccatggtgtgtgtgtgtgtgtgtgtgtgtgtgtgtgtgtgcgcgcaagcactttgtggaggccctgaaggcagcatgtaaggtggtaacacggtagacattctgccccaggtttcagacattgttaggctgaagcttttattggaggtcaaggcagctaataaagtgggccgtgcaattacaagagcattcagcagagaaggatggctgaccctctcggcaggctgagagcagaggaagcggttggcagctcctagtcctcccatgatggctttacaagcattttttgcagccggggtggtaaatgcgatacaaaggcatggtttcaatatatccaatgaggcactctgcttcctgtgtgaggcatccacttgggggaaggaagttgcccggctgtgggctttttgtggtggtggtttctgctaatttaccttttttatagagggctcataattattagggatcctccataatgcccctttatggtggtcaggaaggagataacaaaatgatgcagaggtttaggaggcttctccagggtcacccagaaaacctctggattctgaatctccttcaaagatttaagaggatttatttatgctgctctcttgcccatgtggatctccttgacactacactccgtgagcgtagttaatgtcctgtcttgttcactttgttttttgtttggtgcctgtgtaccaagtagatttctggtgttttgaaaaaaaaaatcacccgtccactgctgcataaccaaaacgtcactggtgtgaaggaagaggatgatagaggatgggacggtggtgacaaatggcgggatgggagatgatgcctgggtgagtcctggaaagtgccgtgatgccatcccactgacatggcctcctgtattccagcaaagagtgaaattcacagggagcacagagtaagagcagcgccttcacctcggtggagcttagtctaggcatttatgggtcggctggtttgagggtccttgcatttcttgtcagtcaatacgtccttgttttggctaagtctcatgccctcatatccacttctacccttgcagaataaagacatgtgggaatgctcactggatgcttacaattggttccaggtgttccagggacgaaacttatcagaaccaaacatagagggcaaatgtcttagccaattcatgctgctataacaaaataccacgaactgggtggcttataaacaacagaaatactgatttctcacggttctggaggctgggaattctgagatcaaggccccatcagattgagtgtcttgtgaggtctgctttttgattcatagatggcactgtcttgctgtgtcctcacgtagtggaagggactggctagctctccagggtctgttttgtaagggcaggaatcccaattatgagagctctgccttcatgacccagtttgctcccaaaggcccacctcctactaccatcactttgggggttaggtttcaacatgattttggggagaacataagcgttcagtctgttgcagcaagcatgaggtcacttgtctagacactgacccctcaggcagtgttcatgtttggtttaatttttccctttatctggtaattgattctgcactgtctccattatttggtgagatggtaacatgtgattacatcccaatggagttgggcatgagaataagaaagaaatctccctttaaaggctttggactaccttggagtttgaagagagtggaggaatgcagtgagctggttttgatcttttggtgaaagtgacaaggaggcaggatggtttttccacggacattgacagggtcgtgctggttctcccaaagagaaatagagtagagttcatcacattagttaagagcacctcttcagcacattatatctcttcagcacatcgtttaagagcatcgtctttaataattcttacatggggcccgcacggtggctcacgcctgtaatcccagcactttgggaggccaaggcgggcggatcacgatgtcgggagttcgaaaccagcctgaccaacatggtgaaaccccgtctctactaaaaatacaaaaaagttagctgggtgtggtggcacatgcctgtaatcccagctactccggaagctaaggcagaagaattgcttgaacccgggaggtggaggttgcagtgagctgagatcgcgccattgcactccagcctaggcgacagagtgagactccatctcaaaaaaaaaattcttacatgggacaaaaatcactatcctatgtcaattgaaataaaggccattagtttttaacactgtataaattgccttttctcctgggaacttcagcatattcttttaaattattagcattttataatcatagaacgatggcatagagggaacctacagggtgtccagcattgcattacagttccctgatgaagagcatggttcttggggtctggccatcccatcaggatttgtatattttgctctgccgcataccagctctgggaacctagagaaggccttaaccattttccgtgttggtttcctcgcttgcacgatggtgttaatcataataactgcttcacaggcgtgttttgtctgctgcatggtagtcattcattaaatgtgagtatccaagctcccatcccaaactgccagaagggaaaagtaaaacttacacttttagacagcgacctcctgactccagggttcattccatctcattaacagtcagttcattcatttttcatttccttatccatccacctgtttgtttatccactcatctacctgtccagcatttctttggccttcaccgtacattcgtgtgtctagacttggtggtggggatgtaaagatgactaagacgcagcccttgccctcaagtccctcccagtctggtggggggggtgggtacagaagccacgtggtaagtgcagagttaggacacttggggagcagccagcatggctccgggctgctggaacattgcatctttcttttcttacaggccccgcctaagaagtgtcatggctgggagggagtcggaaggggtagcttcctagaaggggtgatgatggagaggagttagtgagagaagactgaggaaggtgaggaatctcatagctagagaccagaaacggccttgaggggctgcaggaacccaaagaaatgcagcattgacagacaggaggtgtccaaagtgggtggcccagctgggcatggtggctcacacctgtaatgccagcaatttaggaggccgaggcgggcagatcacctgaggtcaggagttcaagaccagcctggccaacatggtgaaaccccatctctactaaaaatacaaaaattagccagatgtggttgtatgcgcctgtaattccagctacttgggaggctgaggcaggagaattgcttgaacccaggaggcggaggttgcagggagccgatattgcatcactgcgctccagcctgggtgacagagcgagactccatctcaaaaaacaaaaacaaaaacaaaacaaagagggtggcccaccacatcaatttcacaagaagtgaaataacaatgtaagatttatatgtcagttttaacaagtgatgataccgtgtaatacatcagtatagcagtacgatagccatgttcatagcagccttattcacaatagctaaaatgtagaagctacccaagtgtctgctgacacatgaatgactaagcaaaatgtggtatatccatgcaatggaatagtatccagccctaaaaaaaggagattcaggcacaggctatgacctggatgaaccctgaggacattatgccaagtgaaataagccagtcacaaagacaaatattatatgattctggtgatatgagatacttagtgtagtgagattcatagacatagaaagtaggatggtggttaccaagaattggggaagatgaaaagaattctgcatatggaaggtggtggtggttgcacaatggtgggggcgtacataatgtcactgagctgcacgctgaaaaattattatgagaggtcaatgttatgttgttttactgggcgcacacacacggaaagtagtataagttgtgtcacaaaattgtatttgacggaagtgatatccctgtgcactggtcgcccagtgacggctcatgagggtaatcatggtaatacgtacaatctggccaccagagactcccaagcacgttacaagcagtctcacgtttgatccaccctatgagacaggccactttacgggtaaagaagctcagtgaggttagatgcctggagacgcgggccggggaggctgtggtcctgcactcactgcacagcccttcctgctccccggcctccctgtgaggctcactgcagtcccttggagggaaaggggatgctattgagaattggggccaggtgaatggctatagagggatgcaggagtcccccccacctttttctctcctttctcttacttccacggaccttctgagaatagggctggccctggcagccaagagccccttagctcctccctctgcatttgccgtggtacgacgtgtgacacgggccagacccacgctgctctgttctgcaggactcagtgcaagacagctcttttatttgtgcctgtggtcgttagaaaagttttacacgggcagggcagtcgtcatcactaagtaaacacattgagccggcaaatcagtctttgtgagagcagcacattaaatggttccctgcatagtagttactgatacattactataattacatcgcacattttgcagtaaactccaaaaaaatgatttattatctcttgggtgcttgacagcaatatgctcaatggcagcataacttttccaaatctgcccacacattttatgtgtatgactcttttggaattagaccaaatggacccttttaaagatctgctgagttaacaccaccttatatttatatggctgcgttcttcaggccacactgtactgggtcattgccactattttcccacctttctctttacacccctttaaggagtatcatggccagatgtggcgtggtgtctcttaaattcacttaatagacaaaagagaaggacatctctaacagtaatacaagaaaaaaaaagagagagaaggacagagagaccaagaaactctttttttactcctattcagcaactatgtatgtacttatttatttatttatttatttactgagacagaaccttgctctgtcatccgggctggagtgcagtggtgcaatcatagctcgctgtaacctcaaactcctgggctcaaacgatcctctcgccacagcctcccaagtagctgggactgcaggcatgtgccaccacacctggcccctcagcaactatttttacagtatcgactctgtgtcaggcgctgttctaggctctggacgcttgatgagtgtcaccagtgagcttaggacagagctgacgtcttctgcctattctttggctttactccccatagggcttttctggagaagggccctttggagcttgtgggatttcagggtttattgaaatttatttacctttttgcaggtgtctcatgcttcctcggttaaggaatgggaattatcataatgtataccatggtgtctggccacagatgaagtaccacagtcatcagattatgaagcctccaagcttctcttgcagaggactccttcaaaccactctcgtggactgtggctaactgggagtttctcctgggggcccattgctcattccttgctgtctctcccggttgagacttcccaccagggtgaaaagctagaacagtggcttttgtctttagcaaggccattagatggtacagtaactgctttcagatgctgctgatgtggcccagattcagcatagtgacccagaggtgaaaggctacatattccattacaacccctagccaatctgcctccagactctagtgcatttcagtagagaaaggaaggaggatagggtgacatacacactagatagcagctagaagtaagtctgggaaaatctaagaatggagcttcaatttctagagatgcttttgtaaagtgcattacttatgtgctgtgaacgtgatcatgatggattattcaggtaaggtggagacgagaacacagagaatcagaacagggaacttggaagaggcaaagtaaacaggcatggttgcctgtttattttgaggtttcgggtggctattagccctacaaatgccagctaagggcaaatttctgttggttgagattctttgagattctgtcaatgcaagattttttaaaaagcaagtataaaagatgagaagatgcagttttgtggcaaagcgtagaaagtcactaagtccacacatgattaaaaatagtgaagagaccataattcaagtcatatgatctcttttattgtaatcatatttactcaaaagcctcttcgtttgttccatttctaattgttttctcttcttgtgtagagttaaaagagtcacgggctttattgaagggtggagaaattttattttcagaaattttgcctcaatgtttattccctgtgagacactgacattttcttctcaaaacatatatatctatatctatatctatatatttagatgtctatatatatagatatctatatctatatatatagacatctatatatatagatatagatatatagatatagatatagatattttttttgagacagagtctcactcttgttgcccaggctggggaacgagctcagctcactgcaacctctgcctcccgggttcaagcgattctcctgcctcagcctcccgagtagctgggattacatgcatgagtcaccacgcccagctaattttgtatttttagtagagacggggtttctccatgttggtcaggctggtcttgaacttctgatctcaggtgatccgcctgcctcagcctcccaaagtgctgggattacaggcgtgagccttgtaattacaggtgccttgaaggcgcctggccttcaaaacatatttgtttagggaaaagtagtgtcagatctatgaaggtcatactggaagttgctaataagtagaatgccatatttcatggaaggagaccagagttcaggaagcatccttcccacagggtctatcatgggatttagttccttctttttctgcatcccagatgttcctggaggtgcatacttgctggtaagcctggagttggagggatgaaagctaccaaaggccctgatgggtgttatataagatgccacgtgtgagccactccccacaagacgccaacaagcagggaacctagttcagcactttcatacccagtctaaaggcttctaggaaactgtgggtcagctggcccactcctattaaccatgccttcatctgtagtggaaggaacatggctcacaggatgggctagcaggcgatggggcctttgactttcagattagtcttcctgcgacttttaacggtcatgtttacttttgaatataacctgggatgaagcatttatcagcctctggtacttttgtgaattggtagtttacagcgggcttactggtagccttggccagctctttgccataaaatctttaagcatagacacacaggggtatggccattccctttatttttaattaattaagtagtttctagagggagggtttcgttctgtcgcctcgactggagtgcagcagcatgatcctagctcactgcagcctcaactctctggctcaagcgatctgcttgcctcagcctcctgagtagctgggactacaggtgtgtgccatcatgcctagctattttttaaattgcttgtaaagatggggtcttattgtgttgcccaggctggcctcagatgcctggcctcacgcctcctgccttggcctctcaaagtgctgggattataggtatgagtcactacatctggcccatgagtcactgcacctgtcccattccccctgcctttattgattcctacttccgcctaggataacactatctcttaaaagagtgttgccaagaaaccccatttttttacattctatattgtattttaaagaggaaaccctatttagagatatttttgtgggaatggttttggagtttcaaacttctgaagaacctggactatgttgggggcatttacggtggcagtgcacacggctcacactgacgaatggctcggctgagcaagccagtgaagcagagggcaggagaggtgacttcctggcatcctggatctctgcaaatgaagttgctgtagcgccattatttacctcactgtatgtgaaatgaaggggtaggattcattgccttttggttttgattttacttgtccttaggggtgtgtgtgtgtgtgtgtgtgtgtgtgtgtctttccccctggccttctggtgacggataatggtgatggcagtttaggcctgtttctgattagtaaaatgacccttcaaatgagactaggagaaaaatgctctcctgaacctctggaaccctggtttttcctatcacaagtttaatggcttcaggtcctatgtttttagccgagaaaatgaaagactcagtcagcggggattagggttttttgtttagagagaaggtaaaaaggttacatgaagatttggtgtgggtttagactggggttagcctccacgtaggaaaggtctgaagatcgagaatgaggccaggttgtgcaggtgagcagagctatctttggcagctagattgggatgtttctgggcagagatatttgtcccttaggagtgtatcaaatcacagaggtcacatctgactgtcactgctttgttacaggagaaagacctgttcatcagaataattcctacgctttgagccacttattcaagtgatgctagtcacgttcagaaaacagataacctaccatgtgtttgtgctgtgctaggagttctagagctttcaagcacaaccgtatatccgaggttgactttggagctgtcatcgtgggtttggggctgtattttaaaataagaggagcggtgtcttttgggctttgcttttttttcaaatgcttttttctgagtcccttcagtgatccattcttgagctgtctcttcagtcgtcagtctcttggtagtctttattctaagtttttttcctttttaattgtagtaaaatatgtatagcataaaatttcccatgttattcctttttaagcgtatggttcagtggctttaagtaccttcatatcattgcacggccatcgccaccatccacccacttccatcatctcaaaccaaaactccaaatgcattaagcaataacttttgttattaaagtgtttaataatcactttggtgctgtttaacctctttaccctgatttcctccccctttcttgctccttttctagtagtttctactaatagatcacctgagtaagactgcccgtgtcaagcctggtgtcaccttaggttttggggataaaggctggtggtaccgcctgtgacgtgggcttgccacatgcagtgtctgagtggagggcaagtggggccggctctacagccatccgagcagacgggggctctgtcccttactcctcaggcacctgacgttggacttgcctctgggtaaataattcttatcaagcatttacttggaacaattcttaaccatgttttttttttttaaataattactgacatttgtactttaagctgtatacaaatgttcatatttgacagatattctaagcattagagatatttaatgaaaacttgtaaataggcaaaacgacatttaaaaagactgcccctgtctttgtgaaagcagcaaatagttctcttggctcccatttccccctctccactctaaaatatttttaaataaaatagcgtttgaaattctccagagaatgctttaaagagaaagatccacgtgacctcattaagtcattcattcacgtattcatttatcacacatttatcaggctcccaatatgtgccactttctctgtgttaaatactatggattcaaaaacaaaggaggccgggcgcagtggctcatgcctgtaatcctagttctttgggaggctgaggcgcgtggatcacctgaggtcaggagtttgagaccatcctggccaacatggcgaaaccctgtctctattaaaaatacaaaaattagccgggcgtggtggtgcgcgcctgtagtcccagctactcgggaggctgaggcaggagaatcacttgaaccccaggaggtggaggttgcagtgagccgagatcacgccactgcactccagcctgggcgacagagcgagactccgactcaaaaacaaaacaaaaacaaaggagaccccaacattggtcgtgagaagtttaccaaccaggaggggagataagtgtgtaaacaagcaaacaactgtcgtaaaggctgtggcacaagagtgggtgggtagaattcgggtaatccaggaggtgtcagaaagaccaggggtggacctttcatctgagccacgaggacaagcaggtgtttgctttggagacagagggtggacaggatgttctggagagctgcagttgcggggcagaggcagtgaggcatgaagcacctggcgcatggcctgtgcgggcctgggtggtgagggcaaagacagtgagcagaggaggcagcgcctggggggcctggccagggaccccaccccctgcatcctgatgaagaactgtaagaggaccatgtctgtgtgcctggataatcgctggcagcagcaagggaatttcgaagcaagatctcagctggagacaggcaagaggctgtcgccatgcttttaaagaagtatcagagatattttgcttttgaaacatttggcttcactggaactttcgtcttcctatgaaatattggaggatgtcagatcctcccccatttctaagagtaggagagactcatgtatctttctctttggggtaaacattcagcttcagatcctgcaggtagcagagagagagagagagagagagaggagtggttaagagtgtggccattggagtccagggagtctgcgttctaattctggctctcctcttaaatagtcctgcagcttgggcaacttactcaactgtgtccttcctcaacttccacatctgtaaaatggggagaacaccttcctttcagggttataggcaaatgaggtaataatctcttttaaaatacttagcccaagtaaatgctcagtaggtgctagctatcatctccagtttctatttcctgaactgtgaccttgactaaatgtggcccagtcctttaagagaggggatttgtggtcactttaaaaaaatcttcagctgtgctcatgtggtccggagtactgtgttagttttcctgcctgtggctcatgggccagtggtcaccatggaaatggtggtggtgggggtaggggtgggggaagagaaggaagccgagctacagagacattcatacacttgttcgtgaccacagcaggatttggggtccttctagagtcactgctgcaggattctttttgtttttttcttttttagaggtggggccttgctctgtcaccctggctagagtgctgtgaaacgatcacagtccactgtaaccttgaacaccaactgcaggattcctattctcttttgtgggcaagatagggtgggggacattgtgcacccccttcttctctgtcccagtctgtgacagaccctgtcagacattgagaggcctgagagctgcaacagtggttgtgccagagaggaatttgccaaagctctcagcgacctttctgcattaaagtttcgtgccattatctctttcacatacaaattcaagcccttttttttcccttgaaatcacttttgtgctgtttaacctctttaccccgatttcccccccttctttcttgctccctttctagtagtttccagctaatggatcacctggataagattgcccctgtctttgtgagagcagcaattagctctcaccctgagaaggcggcgtgttctgttgcttggcagccttggtgtagaggatggattgggtctgcgtcttttcatttgaaagtaggttatcgattagcacggatgccaatttactacagaggctgttgccaatgcctcttgatctcattatggtgtaaattttcaagattgtatcacattagctcaggagaattcaggagagaaaaacgtagtaaagttaaaaaaaaaaaagccaaaaaaaaaaattcttccattatattatagcccaggcaaaaataaacatggctacagctggccatgttcggaaaggacctgcggtgtgtgtgtggctgggttggttatgagctgtaggaaaacctagcgacaggtttcaaagtacttcatgtttttggtttattccttcgatttcttttaggactgattttcttgggaaatggtgatttttagggaaactgcagactgttgggtctatttttttatgacaagagccctctagtctcagctttgtgagacagaaaaaggaggcagggacagtgagatggcagaggaggagatgctggcgaccgtgctaatgctagctaatgctaattttgaggaccagatagtttgggtgcaggcctaactgttgttcagttaggaatctgagatcattcccttccaaaaagtggctttattgagatacaatttatgtgccataaaattcacctgttttaaacgtgtgcgggcctaactcttggccaattaggaatctgagatcattcttctataaaaaatggctttattgagacaatttatgtgccatgaaattcacttgttttaaatgtccagctcggtgcatttccatttattgccaggtctgcagccatcatcactatctaattttagaacatttctgtcactccacaaggaaatggcccattatcagtcagtcttcaccctactccactcccaggcacaggaaaagactaatctgctttccgtctctgtagattttccttttgtagcattttacatgaacaaagtcatacaatctgaggccttttgcagatggcttctttgagttggtacagtgttttcaaggctcaccctgttgtagcatgtatcagtacttcatttctctttattgcctggtaatattccactgtataaacataccacatgctgtatatccattcaccagtcgatggctatgtgggctatttctagtttttggctattatgaataatgctgttatgaacatttgtgtgtcaatttgtgtggacatatggtttcatttcttatggatagatgcctaggtgtggaattggtagttgatatggcaattctatgtttaacattttgagaaacttttttttttgaaatagagtctcactctgtcgcccaggctggagtgcagtggcgccatctcggctcactgcaacctccacctcctgggttcaagtgattctcctgccccagcctcccgagtagctgggattacaggcacgtgccaccatgcctggctaattttttgtatttttagtagagacagggtttcaccgtgttagccaggatggtcttgaacctctgaccctcgtgatccacccgcctcggcctcccaaagtactgggattataggcgtgagccaccacgcccggccccattgagaaacttccaaactcttttcccaaatggcagcaccattttatattcctcccagcaacagatgaggctttcgatgctagtatcaccctgtagctttgatttgcatttcactaatgaccgatgaggtatagcatcttttcgtgcttattgaccattcatatattttctttggaaaaaacatttattcaaccttttggtgttttttaattgggctatttttgttgttgttattgagttgtaagtctttaatatatcctggggtataagtctcttatcagatatatgattggccagtattttctcctggtctgtgagttatcttttcactttcttgatggtgttgtttgaagcacaatagttttctgtttgatgagatccagttgatcaatttttcttttattgcttttggtatctaagaagttgtctaatccaagatcatgaagatttacttccagatttttgtcttaagagtttatagttctggttccaacacttaggtctatggtccatttcgagttaagatcactcatttttcttgcataaagaaattttccagactcattcaggtttcaagaaaatagacttagaatgaccactgtggattttcttttctgtccttcattttctaacaaagcatatgtagtggccgtcacatgctgggtagaatcaagattgcaaagactgacgtaagaatttggcacatgagcaagctggagttggagatcctgacagaatctctaacacatcttctgagggtgggagaactgtcacagaagcaacctgcaggtgtgagatggactccagggccttggcactcatcagaagaaagcttgacctcctcacctgcatggggttggggaacaaagcaaattaagcatcagagaaagacctggcggtatgacacgattaagccataatggcaccagggcacagctgccaagcaggttgtcagaagggcagacagagtgatggagttttttgttggggtactgtcatatagttatttgatgaagccatctctctgtttttgactacattcttgctttcattggattttttcctacatcttgacccctaacctcctgcaacaggtatgggtgggagttgttgtttttttttttttttttttgagctttcttaagtatacctgtggttttcctccaagtcccccaaggatcagttatagctctgggaaagtggggggaagtgagatgctagacttatttttaccaaaatccaagactagtgacacaaggtagaagtcactggatggaatgaacttgtaggatattcccttttggggcactaatcacaaaggcaaattgaatggtagagtgtcaaggtgaactttaatactttgtaacatgagctccaggccaggtcttaaaacatcttggacatattgcaagaaatagctcagccctatagcacattgaatgagaatggagagtggatcctgggttggctttagactctggccttggcgtttgtgtgtacacatgtgcgtcgtcatctgtgcacacaggtacacaaatgtgtctttataatctctggggaagcaggttcacttttaatgttctttcatctgctatttgattttaaaatcttgggggaaagtattgaaaatcaaatgtactcatctgtcctgtgtaaaaataggagtcaaaattttaaaatctgaatttatgcaacaaattaaatatggagtgttacttctcatcacaaaataatctagccattgttaccttcaagagagcagtttctcattgatgcaattaaaatgaacttctcagggattcttttactataaacggaggtgcacccaaaccttatatctctgagaaaacagtggctgtgtaatgagtggtgaattgtttttggcgagtgtggctgccaggttgcttcctcctaaatctgagatggtagacagaggtttattattgctgtagcagatagagagcgtcttgcttgcactgcagaagtctgcccagagcacttaattagacatttctgtggctatttgcagcccagtacaatgggagatcaggggattccagattggaatcctagacatccaaatccatagttagcgttcagagccaaattttttattgcttctctgggattatgctaatcattcaattcaaatttattcaactcacatttttgacattctgctgtgtgctaaggtggtggaaatactttttttttttttttagacagagtcttgctctgtcgcctaggctggagtgcagtggtgcaatcttggttcactgcagcctctgccccccgggttccagcgattctcctgcctcagcctcccgggtagctgggattacaggcacccgccaccacacctggctagtttttgtatttttagtagagatggggtttcgccatgttggccaggctggtctcgaactcctgacctcaggtaatcaggtggcggagatacttaatgaaacctggttccaaccttcaagaatagcacaaggaagggaggggggtctggataaaatcgaaaggtacaagttgtgttgggactaagtggatctaaacatgctttctgaggctgtcattaccccaaaagtcagctttgtgtcaatcaacaaacactgtggtctgtcttttctctcagcaaagtctgaaggagtgggacactccaactgtgtgtcacaggaatgagctgtcatctggcaatttacagaccagcttcaaggattccatttaccaccagtttattcacttgtatttctaatatttatattttcttaagatgatcccctctcccatgtgtgctaattttctaaataacagccacatcgacaaaatgccccctttgatgagtcatgggctgagctgggttctagtgatgctggctacaaccttgagagttaaagaaaagctatttatattttctttttattattttattttattttattttattttgagacagagtctcactctgtcgcccaagctggagtgcggtggcgtgatctcagctcactgcaacctccgcctcccggattcaagcaattctcctgcctcagcctcctgagtagctgggattacaggtgcccgccaccacgtccagctaatttttgtatttttagtagagacggggtttcaccatgttggtcaggctggtctcgaaccccttacctcgtgatccacccaccttggtctcccaaagtgctgggattacaggcgtgggccactgcgcctggccctatattttcttaagatggtcccttctcccacgtgcgctaattttccaaataacagccacatcaacagaatgcccccttcgatgagtcatgggccgagctgggttctagtgatgccggctacagcctcgacagttaaggaaaagccactttcgcaaagaatggaccctgcttccgtaaccttgggttaaatgttgtctgcgagcaccttactgagtttcttcattttttgctttatttgggtgcagctaaaccagctaaacagccttaataagttactccctgggatacaataagctccctgcatctgtgaggtgaaaggcagcccagtgaattctgtcgacagtagctgttctgagaaagtgagcttgaaagggggtgtaggagtcaaaggtgagaggtcatgacgtcagtagtccaaacacctggaggttttagtctaacttcctttcttgttacttagccaggcagtaagttacgtatctctaacttggccttctgtaaagtgggactcttagtacttgccctgcttatctttcagacagaatcaaatgaaatagcagaagtgttttgtcaattaaagtgacatcagatgcaaagagtattattatatcatcatcatcatcatcaccaaaggaactatggtaatgttggataaaaagccaaatacttttttttttctttctttctttctttttttttctgagacagagtctctctctgtagcccaggctggagtgcaatggcgcgatcttggctcactgcaacttccacctcctggattcaagtgattctcctgcctcagcttccagagtagctgggactacaggcgcgcaccaccacgctcagctaatttttgtatttttagtagagacagggtttcaccatgttggccaggatggtctcgatctcttgacctcatgatctgtccgccttggactcccaaagtgccgggattacaggtgtgagccactgcactcagccaagccaggtacttttctaagtaatttaattctctagaagaaaagatgataagatctttgcctggaactggaggccattatcttaagtggaacaagtcagacacaaaaagacaaatactgcgtgttctcacttataagtgggagctaaataatgtgtacacatggacaatagagaaagacagacagtggagattgcaaagatggggcaggttgatgaggaatgagaaattactgaatggacaccatgtagtttattccagtgatggatgcattcaaagctcagacttcaccaatatggaatatgtccatgtaacaaaattacacttggaccccatacatttatacaaaaaaagacctttgacactaggcataactagtggtttggttaatgcagaggagtattgctgtggtcgctttcttttaaccagcttgagagacagtacaagagaaggttcaggttcttgtcttgacagaagtctcagtacacccacctgtactttaggagaatgtggattggaaggctcttggtgtttcagttttctgagtgggtttgagtaattatgttggagagggggaggttgatgagagtgtaacacacttttcgtggctataagagatgataataaagagttattagaacatttattagacacatgatagggaaagttggttaagggccttgaagaacaggcaaaggatgtggaattcatgtttttgagctctagatgatatgatgaaaattgtggttgaggattatttttctgatcttgaggaaattcaagtttgaatgatgaggatgaatgaggttaatcaacactgaaattggaatcagaggcaaattcaaggccgggcgcggtggctcatgcctgtaatcccagcactttgggaggccgaggtgggcgaatcacctgaggtcaggaattcgagacctgcttagccgacatggcaaaaccccatctctactaaaaatacaaaaattagccaggtgtggtggcacacgcttgtaatcccagctacttgggaggctaaggcaggagaatcacttgatcccaggaggtggaggttgcagtgagcctggatcgcaccattgcactccagtctgggcaagaagagtgaaactccatctccaaaaaaaaaaaaaaaaaaaaagaggcaaattcaagacacagtagaacaggggtgtggtcggtgaagccgggagagtaggcaggaagtgaggccagtttgggaaccagcaaagcccacctctctctcgaatagcccctatttgtcccaagatcttactttcctaccatcatgtttggttttgactgaatagctcaattcagagagacatttcaactttccctctgtgctttgcaaactgatgacgaagatatgttttaaggaactagctcccaagttagttcctcttacaaagatgtacagattttaaaactgaacatgtgtgtgttgctgctgagaatgtaaaatcatgcagctgctttggaaaatgatacgacagtttttcaaaaaattaaacaaggaattacatatgattcagcagttccacttctggtataaacccagttgaattgaaagcagggactcaaacaaatatctgtacacccatgttcgtagcaacattattcacagtagccaaaaggtgggaacagcccagtgtccatcatggatggatgagcaaaatgtggtctatgtatttacaatggaatattgttcagaaaaggagtgaaattctgaaacaggctacaacatggatgaaccttggagacatgatgccaagtgaaataagccagtcacaaaggacaaatgttgtatggctttgcttacacgaggtacataaagtaatcagactcagacaggaagtagaatggtggttgtcaggggctggagttgaggggaatggagagttattgtttaacatacagagtttcaattcgggaagatgaaaaagttctggagatgatggtggtgatggttgcgtagcaatgtgaacgtactgaatgccactgcacacttgaaagtggctaatatagtcaagtttacatgtattttaccataataaaaatggtgaactgtcattatcttgcattgttgatgcttttgttcaaatcctgggaaatatgatataataaatctcttcttatgttattccaggtctggaaagtgaactctggttaacttttcaatatcattttccccaggaaaacaaaagataatgatgtttcctaggccaaacacaccttgttaacatttccataacaaaacagcaaactgtcatttaaagtttatctcactgttattcttgagccacaaagaagcaatgtttacagacgattttacactaacaattggatgtgctggaaatgggtatttgggtgatctcagggttcgtgaacctcaggctgtggagtgttcttgttctagatgtccgctgagagttttctttctcaaggggctcctaaattagaggtaagccccctaccacctgtgtgatcccccagaagttagaaccttgcgccttctctgtggcagggaggagacctgtcctctctagagctggaaggttgtgtgttaacaaagttgaaggcagtcatattagtctgttttcactttgctgataaagacacacatgagactgggtaatttataaagacaaagaggtttaatggactcacagttccatgtggctggggaggcctcacaatcatggtggaaggtgaaagtcacgtcttacatggtggcagacaagagagaaagagagtgaagtgaaagaggagaactcctatgagaccatcagatctcgtgagacttactcactaccgtgagaacagtatggggggaaaccacccccgtgattcaattatctcctccccggtccctcccacaacacgtgggaattatgggagctacaattcaagatgaaattaacctatgaaaccatcagatctcgtgagacttactaccatgagaacagtatggggaaactgcccccatgattcagtcatctccccctgggtccctcccacagcatgtgggaattaagggagctacaattcacgatgaaatttgggaggggacacagccagaccatatcagcagcctatgggatgttcccccgagggctccacagccgggtgctcagattgctgggactctcttgtcaggacttcttccttcttttttgcctaggtcttatcagaactaagccatttggtttgtaatctttcctgtaacactggctgcagggtctttagcctggattctagattggagggtacagggcagcagcctcacaggtgcccattagcacatcccacaagcagtcacggcactgcacttgcactggaaacagcttctcattttcccgggagtaccttctgccaactttgagaacaccaattcctaattcctgttccagtatccactttggttttatacataggacatcttttcctataagttttccctgaatgttttgttttgtttttttttttttttacatttcttacagatgtctattaaaatctcagcattcttataaaatactctttgatttgaagaaagtagtcattttcccttaggcttatgatgcctcagtctccctataagagataagaaccaggctgggcgtggtggctcatgcctataatcccagcactttgggaagccaaggtgggtggatcacctgaggtcaggagttcgagaccagcctgaccaagatggtgaaacaccatctctactaaaaatacaaaaattagccggtgtggtggcaggtgcctgtagtcccagctactcgggaggctgaggctggagaatcgcttgaacctgggaggcggaggttgcaatgagccaagatcgtgccactgcactctagcctgggtgacaagagcaagactctgtctcaaaaaaaaaaaaaaaaaaaaaaaaaaaagagataagaaccagatatgcataaatatgaatatttgttcatttgtaatctggctcttcctgtgataagatgccaccaatatttgggtagaatgctggggagaagttacctcccaacattgaaaagagtaaaatcccagcactttgggaggccgaggcgggcggattacctgaggtcaggagttcgagaccagcctggccaacatggtgaaaccccatctctactaaaaatccaaaacttagctgggcgtgatggcagacgcctgtaatcccagctactcgggaggctgaggcaggagaatcatttaaacccaggagacagagggtgcagtgagccgagatcacaccactacacacccacctgggcaataagagtgaaactcttgtctcaaaacaagcaaacaaaaaggattaaatatatataaaaaaatctagaaggaaatatatggataaagaagtttctaagcttgatagaatagaaggtatcacaagagaaaatatagacaggtttgactacataaaaattaaactctgtatatcagaaaacatttgtacgttgacaaaatcaaagggcaggcgacaatctgcagagaatgtaaaaaattacaacgaagcatgaatatctttaatatagaatttttaatacaaattgctaatgtcaacattaagaccgcagtagtttaagggacaaaggcagttgaactgactttgcaaaaggggaaacaaacacacatggctaccaaacgcaagaaaaattgttcaacttcattagtaatcaaataaatgcaaatcgaaacaacagtaagctaccatttttgatgcagcttaacaaagattttgtaaaatgtgatattctttcatataatgaaggataaattaataccattttggaaagcagtgtgatgaaccttaaaattattcttactccttgacctggtagttctatttctgggaatctatcttaaggggataatcctaactaccaggattaatgcacaaaagtatttcctgaagcatttaaaaaaaataattataaagaattagaaagaagctgcatgttcagcattagggaaatggttacagaaattatgatcaatctatttgatcaaatgctgtgtggtctcttaaaataacatttgtaaaatgtttcccatgtttcaggggacgtgctcatgatataattaatgctaagtgataaaaaagcaggatataacctcaaatgtaagtattttctggtctagacagtttaaaacttcacaggaaagaaaaaaaaggatgcttgctacaatattagcagagaataatattgatggctgctggtctcccctagtaaactgtgtttcctaaaagggcatacattactttaaaaacatttttaattttgagatattttgtaaaaatttgattctcatatatctgtcttaagaatttattatataaatcatccttgaataaactaagttacatagttttcaaactctgtctcctgctaaatgatcatctatactgatgactttttaaaataatataaacttccaggagggaggaaagaggtatgtttattttaggggcctccagagcccacagtaactcttccttcttggggagaggagtctaaagataacaggcctgagtttgtgaactctcatctctagtatacttgacttcttctatgtatttattgattgtgtggtatcacagatttggggggtgcgtgtgcaggtgcacgtgtcccgttctgtagtggtggggattgggtttctagtgtacccatcacctcaatagtgaacattacacccaacagataatttttttttacttttagtctcagggcactgtgcaggtttgtgatacaggtaagttgtgtgtcatgggatttgctgtacagatgatttcatcacctaggtagtaagcatagtacccaataggtagtttttgagactcacccttctcttaccctccaccctcaaagtaggtcttggtgtctgttgttcccctcctagtatccatgtgtgctcattgtttagctcccacttataattgagaacacacggtatttggttttctgttcctgtgttagtttgcttaggatgatggcctccagccccatccatgttgctgcaaaagacatgatcttggctgcatagtgttccatggtgtatatgagccacattttctttatccagtctactgttgattggcatctagcttgattccatgtttgcactattgtgaatagtgctgcagtgaacatacgtgtgcatatgcctttatggtagaatgatttatgttcctttggtacttgacttcttattgccattgtgttcaccaaagacaatcatatgactcagtctgtttcaattggtttgaaagcttaggctttcctttttaaataaaccggaaagcttaggctttcctttttaaataaccttttttcaaaatttcatatttttttctcattttaggaatgtaataatagtcatcatgcgttaagagctttcaaagaaccagatcctgttctaaacactttatatgtgttacatcatttaatgttcacagcaatcctctgagatgtaggtactgttatcatcccagttttacagatgagaaaactgaagcacagagaagtcaagtaagtggagaagcccatgttcaaacctgagtcatctgtcgccagagcgtccctccactgcgccagatttatgacaacttacttgttctttatgaaggcagcaactcaggcacagtaggccaaggctgccatctgatgaaacaactggcaaatcaatggcagagaaagattcagagcagagacagggctgcgtccattgatcgtgttaggacctggaccatggggcgctagaaaatgacatggacgccagaaagtttctttttgctgctgactgatcatttatgaactttccatggacttttgaaaataatatcaaaataataccactagaattgttaaagcattccacgtaggacactgggtcatttgatttctgtaggaaaatgtgattttgtaggaaggcgtatggtagtttcttccatataaggccattatctcgtctttgaacctaatttctactgcagttcaggtttggagaggcctaattcatcgtggtggcacagttttaaaatttgcccctcatttggaattgatttagagtttccgtttacatagagtgcttgatgcaggaggcagttatggaaagggaggccctctctgagcacggtgcatggggttagagttgcctagattttggtaacatagtgacactgcaaacaaaactctatggaaacaaaataattttttttttctttttggacacagagtcttcctcatgcagcggtgcaaactcggctcactgcaaccccttgggttcaagcgattgtcctgcctcaggcccccaagtagctgggactacaggcatgtgccaccatgcctggctagttttttgtatttttagtagagatggggttttgccatgttgcccaggctggtctcgaacatctgacctcaggccatccacccaccttggcctcccaaagtgctgggattacaggtgcgagccactgcacctggcctggtttttactttcaaatctgatattttagcctgttagtgttaaccatgtttaactgactcaaatgaaatgctggccctggctcccatatagccagaagaataagaatgctggtaatcaggtattggcgtttcttcaaaaagccaaaatctgttgtaatagaaatactggtaatttcttcactctgtgaagtacatgtgtatgggggtgtgtgtgtgtaggagagggttgaagattttaacagttgtttgcccaaggttactatataatctaaacatatataaggctccaaggcatttagcttatggggaaaattaaatagtggctattttataaaggcaactagttgggaggcctcaatcattgttactttttatgggctctactaggattttatgtaggaaccagtgtgatctggggaggagggattcctttacacacatccttcagaaagccaccattgtattcctgttgcatttgatgaatatccctagtaggtttcttttctccacctgccacctaggtagatcaccactgctgcatgtcacttttactgaagtgagtaaaatctctgctagtagtgttttccaattatgcatatattttcttagtgcttatttggcactgactttggggagtcgtagtctttctgagatgggaataacatcatttgtttgttgcgcctcagttccaccgtcatttaaataggaggcgtgtcgtgatggtgggcaaccttgttcccacctgaccttgtgagatgcgctaggtggattatggtctttgaactacacattgcttgaattccttgggagacgtgggtcacataaacaggagcctgtgatttttcaggattgacggggaggggcatcttcctttcctaaatccttcctttgatctcctcagcggaggtcacttaagcaacagctggctcttctttgcccctggggctccgcttcagggccgggggaaggaggctgagcatgtcgagtgccctgggaaggcccatctgcctgtcaggtgttgtttttccgccaaacaccgaaagagctatgttttgttcctcttaaagagtttaccatccagaagggaaaaataagatagaaagtaaatagctacagcacacagtacctctgaggataggggtaataggattgtggtcaaagcagggtgtgctcggaaccatttgaggcgaccggcaatcatttccttaaaagagtagccttgagaaaagctctaatagatgggtaagattttgatgggattttggtaggagccaaggagagtaatcaaagtggaaaaaggagggactggagcccttgcctggggcttgaggttatcctcgaggtccttcaggatgtccttctgtggcaggaggatgatagaactatttgtttctagtgttttgtatggttttagagccttatatattatggtgacagatccaaggacacaatgatttgatggtgtccctgtaggaagaccccgtttaacaagaccactattttcctggtaaatgagatataagatgtatagtcttttgtttcctcccagcagctactctgtggatacatcctgtgaacttccctttgcaatgattaggatgacagcccctgtctctaagcttctacctgggctccctaagtccattttcttcccattcctaatagctctgaaaacaaccttccactgtgtttcctccagcatatttccgagttgattgtcaagcacagctcttatgatatcactgatctgctcaaagcccttccctggctctcctgttgaatggtgacctgggtgtaaatgcctcagacctctcggtctcctcccacctttccaagccatatccccttcattgactgtgctccaggcaccacctccagagtagacctggggtgggcctcagaactcgcatttctaacgggtttccaggtgatttccgagaaccactgccatagccaagccagacaggtgtggcttaacggacctcagaattctcccttggatatttttttaagtgcatcttccttcactttgattactctccttggctcctaccaaaatcccatcaaaatcttacccatctattagagcttttctcaaggctactcttttaaggaaatgattgccggtcacctcaaatggttccgagcataccctgctttgaccacggtcctattacccctatcctcagaggtactgtgtgctgtagctatttattttctatcttatttttcccttctggatggtaaactctttaagaggaacaaaatatagctccttcggtgtttggcggaagaacaattttgagataagaaatcctactcctcattgattctgttccgcatttggagatgttggcaagtgcgtcgagccactcagagggcacggattagattttattcatattagaatcctctgcatcacccgaccaattatttgcccacagtaagcccatcataaatatttggtgattgaataacaaccttccacactcaagatgttgcaagcctgagaagtaagaagaaagcgctgcatagtcttcctgcttctattcttgtaatcctcttataaaccatgggccttctaagagaacaattattatttttaatgaactggtgtgtggcatagcttaaacctctttattatccttcagcacttagctttgaataggattaatcagccaggaagatctgaggaggggcagggcaggcttcgttcccaggttattgcttttccagtgaaaagcactttgaagaggacagtggagactgatcttttattttaattcaatataattataactttgttttttttacacacatcacacacacacgtgctcacacacttcagaagtctcatggctaacgatggggctgtgtaagttattcattaggaagatttgagaagcagggtcaagcaatggagaaaaggtatatatttttgaggatttatttttagtatttgatataaaaatgtatgagtaatacatgctgattataaagaatgaaaataggacagaagaagatagagtcaaaagttaaagtgcccccggggaagtgtatttatataaagtgacacaggagatattttgaaattttaatgcccaaaagtaaagtaaatgatgttcaccatatagacgacaactaggcacagtttcaccacccaggataattaatgtgtgatttttctggtgtcctcaaaattattagcactcccatgcgtactggagtttcacagatggatttcactttcacatttgagcatttctcagtggtttccagcctcagctctctcttaagcagatgactttagccaagctgagggcagaaaaagctaaggaatgagatcctgtcttgtctcttcctcccctgctccctcccttcctcctaccacccacacatccttcccttttgcagcagatactcgttgagggcttactatgctgcctcactgaggcattgtgccaggtgtcaggaatacagtggtgagcaaaacagacctccagtacttgtgttttgggagattcaaatcaggataccagagtccatgcagtctctggagcagacagcctgagttcaaattccagatcagtacttactatgctatgtgccctcagacaagttacttgtgtctctggcctcaatttcctcatctgtaaaatgggaatgataaaagcatctacctcaaagttatttaatatagggattaaaataaataaagatgtaaagtgattaaaacagagtgtaatatttggtaagtgcttggctgggtgcggtggctcacgcctgtaatcccagcactttggggggccaaggtgggaggatcacctgaggtcaggagtgcaagaccagcctggccaacatggcaaaaccccgtctctactaaaactacaaaaattagctgggcatggtggtgggggcctgtaattccggctagttgggaggctgaggcaggagaatcgcttgaacttgggaggcggaggttgcgtgagtcgagatcgaggtcgcaccattgcactttagcctgggcaatagagagagactccgtctcaaaaaaaaaaaaaaattgtgagtgctcagtaaatgttgttatttacagtcagggtgtgggcagacatttaacaaataataataaataactaggaagttctaactgagataaaggaaagatgatgctctggagagtgtaacgggggttctaatgtagaccggggggtcaggaaggcgtggtgtgcagctggtggtggaaaggaagcccctgcggcagcgtcgggggaggcgggagagtgtggccgctgagctgagctgagctgaggctggagtcccaagcaggggacagactaggtggggcctcagggcatctaagttcacttcattcattttacagatgaagaaactaaggtccagaaagataattgctttgtccagatcacaggctggtgacagagctaaggcaagacgcaggtctccttactcctggtgcactggtgaggaaaccttttaacctcaaactttcatcattttctgtctctatcagatgcaaatctaaatgtccttacacttgttcctggtagggtgccctcgtaccaacagagggcaaatacacgcaagtgtgcacatatatactcccctccctcctccctccctcctcccttcttgagggtggtggtgctcagggtgtatgttggatggtagtgcgtagttgattaggggagaattcaggttgcttctttgtttccagttttaaataatctgacccatgtgtctctttattcatccatcatacctgttcatatatccacatatctttggtttttttttttttgagatggcctctctgttgcccaggctggagtgcagtggtgtaatcttggctcactgcaacctccgcctcccaggttcaagtgattcttctgcctcagcctcccaagcagctgtgattacaggcatgcgccaccatgcccggccaattcctttggtatgtttaaatagagatggggtttcaccatgttggccaggcttggtcgcaaactcctggccttaagaaatctgtctgcttcagcctcccaaagtgctgggattacaggagtgagccactgtgcctggcccatgtatccacatatctactcatccatctgtccatccatccatccatccatccatccatccacccatccacttgttcattgatttattcatgcaatccacaaatatttattgaagggcagatatgtgtcacaaatttgtgttaggtatttttgatggtcagccaaacaaacccggcctctgccctcatgcagtttacagtctgtcagcagcaaatcgaaaggaacatatcctgtgtctacacttccgtgctatcattgtgcgatgggattttaaaaaattcacgagattgttctaacacccacaaggaatgcacactctcgttaatcccacacgactatttctttagtggcttatttgtgtttaatttccaagataggggcggtgatattcccaaatcccatttctctcctaaatctcgttttcacagatgctcagcaaaggatgtagggcgactactgcagcagcacacagcattcaaccaggagtggaatttcatgaactgctctttatttcccttctggtctcttgagtctggttcatcttgtctagagctctgataatctccgagacaaaatatttaaatcttctgcagctctagggactttgaggaaggaatattgtggctaaaatcctaaatattttggaatatcattaatgcaagggttatacagcagatgctgtctggcacaatctccatcccaagagaatgtgtcaatatctttgtatatggaaatgtacatgtatactcataaatttctccagcctcccaattctgtatctctttcccctttgagactgacttttacttcccttctttagcccctgcttactttaatatacattttttctctctgttttcagaaaggggtaaaaaattgttaccataaatgattgatagaggcctgaatttttattgttatctcttccggagtggaaacctgccttttcatagagaacgcagctttaatccaaaggatggactatctaattgttgaatttcaaatataggcagggctgattgagggtatagggtttttcaaacgttcttaaaatcacaatgtatgagtaaaggcataatactgatgggaccacagtacaggacgttttccaaagggcgtgaaagtcattgtgtgacccctgttgatgcctctttattcttgttttgtagaaaaagtaactgatttcttaaaaagcatattaagcccacaccctgtgcccagtatttctttagaacaaccctaaaaaggagacaggattatcttcactttacacccaagacagctgaagacgacagcagctaagaggcttgctcaaggccacacagttaagaattagagttgagcctcagagctggctcttgggtctggaccacctccctgggttaaatacagtcctgtctcagtacacacactgcctcgcctcctgatttttaaggtattacaagttaaacacgcaacaaatagtctagatcagtttcattttgaaataacatagcagttataatgtggatgatattatgcttgaaataaaataatcctgatcatggagcaagcacagtgacctgccttaacagttagatgttagtagagaggacacagagatcatttaaatgctagtaagggcttgtgactgcgttctgaatgcttagtatttttagattcctccaatcgcttctaaccttcagccctgccatggttttttctgtgaccactggaattctaaattcagaaaggttgttagccacctggataattgcacctttgtaacttttaagacaacaacctagaggcagaggataactacaataaatgacttgtaatttcaggtcttagatctctgctttcacataaaaccagctttccacttccttaggttcaccacctgaagaaatcaaagctaagcattaccagaagtcattatctactatttaaagcctgttctaagcgggagacaagccccctttttaggaggcgtgggggcggggggaaggggatccatttctcattttgccatgtttctgcaggaatgtttttaatagggatcctttttacccccagctactctgcagcacaggagtacgactgtatttgaggaggcagcttgacttcatgctccagggagaagtcttttatttcctgttggggttttaaagttgcccttgcttaggtcgttgctgttttataagtcagcctgaatatttaaaggcaggaggcctgttggtctatgttatgttggccttggggcattagaatgacagagcagctttatttaggattgcgaggcaggccatatgtactcaattatcccattttcgaggacttggccatttgtaccacatctccctgcaagccctttcatgagagccactattattattcacattcagtaagacctgagaaatattattagccaggaaagctctcatttacctcgccatctctcgcaacgttactcactgccctcactgcagagcactccttgtgtaccctctaccttaactaagtttgtcccaagaaaatgatgagaaattcttttacgctggcatacacagactaatcaggtttagtgggaagagcgtggcctctcaagtgtggcagatctaggttcacatcctgatctaccggtctgagcttggaaaacattacttcatttttctgaacctcagtttctctgtttgaaaatgggttgaagtggccgggcgcagtggctcacgcctataatcccagcactttggggggccaaggcgggaggattctttgaggccaggagttcgagaccaacctggccaacatggtgaaaccgcgtctttactaaaaatacaaaaaattagccggacgtggtggcgggcgcctgtagtcccagctactcaggaggctgaggcaggagaatgccgtgaacccgggaggcggagcttgcagtgagctgagatcgcgctgctgcactccagcctgggtgacagagcgagactccatctcaaaaaaaaaaaaaaaaaaaaatacacacaaaaacagccgggcatggtggcgcatacctataaccccagctactcaggaggctgaggcatgagaatcacttgcacccaggaggcagaggttgcagtgagccgagatcccactactgcactccagcctgggtgactagagcaagactctgtctcaaaaaaaacaaaacaaaacaaaaacaaaaaaggccgggcgcggtggctcatgcctgtaatcccagcactttgggaggccgaggagggtggatcatgaggtcaggagtttgagaccagcctggacaacatttttagtctctactaaaaatacaaaaattagccaggcatggtggtgtgcgcctatagtcccatctacttgggaggctgaggcaggagaatagcttgaacctgggaggcagaggtttcagtgagccgagactgtgtcattgcactccagcctgggtgacagagcgcgactctgtctcaaaaaaaaaaaaagaaaatgagttaaagttacaaggaagctgattttggcatccataagaaaaatgggcacaacgatcgttgctttttgcgtggattgccacaagaatgtttttggattcacagatgtttaatactacacatcactttctccttctcctacttttcccataggttttcattcaacagatatctgttgattatcttgtggtgtttcaagatgtgtccatctgcattttagctgggcatatgcccaaacagcatagatttcaagctgtcacaacccaccatgggacagatacttcttaaagtgtgtgtgggttgcgttactgggacccccaattgccacaccgctagcatttgtccacttgtaaagattttcttacttgtcttccttgttgaatcaggaagtggacttttacatggtgcatgcagtttttgatgcgcttcctctccctgctccctggaggtgccgcatgaaagcgcttttccctggacgttcagttccctctccactccttgtctctgtgcatcctgcatcttggcatctccccccgtgacatttattcctgtgaatctgaaaacttcctgtatgttttgtggctacattcgtattccagttgctagagcagaggggagcgggtgctgccacgtgaactttggtgttgaaagagcttcaggataaagttttcagaggacctgctatcaaccaaagctacttgaatataattaggaactaggtccagttcctaatcatactccagaggaggataaatccataggctgtccccaagccagttagctctgagtcagcaatgagcttacatcttcacacgcagatgctgtaggtttacttcatatgtccttctgcagtcattgtcctgcacggctcaggtggcagtgacatactggctagggacatggagaggagctctcacaagggatctggaaggtacatcaggcctaggagagaggaacaaatgaaaacggcactggggcttcatggatggtaataattcatacaggagactttccagttagagcactaagtatcaacactatttggagcatcactccaaactgtactcatttcaaactataatgaaatgcgtcttctctgttgtaagatctctctttttttttttttgagatggagtcttgctctgccacccaggctggcatgcagtggtgcgatctcggctcaccgcaacatccatctcccaggttcaagcaattctcctaccttagcctcctgagtagctgggattacaagcgcccgccaccatgcccagctaatttttgtatttttagtagaggcggggtttcgccatgttggccaggctggtctcgagctcctgacctcaggtgatccacctgccttggcctcctaaagtgctgggattacaggcgtgagccaccacgcctggctgttgtaaggatctcttaaatttctcttatggcttcgtctcaaccacagagcaaataatccccttaaaaatcttaagtttttagtttttccagggctttattttgtgtgattttttttttctttaagagatgaggtctcactctgtcacgcaggctggagtgcggtggcagaatcatagctcactgcagcgtcgaactcctcagctcaagtgatcctcccacctcagcctcccaagtagctgggacctcagatgcacaccaccattcctggctaatttttaacaatttctttttgtagaaatggagtcttgctatgttgcccaggctggtcttgaactcctgcctttgagtgatcttgctgccttggactcccaaagtgttgggatgactggagagagccactgtgctgggccttgtttcttaattgttcatttaacaggcctggttggggtgtgaaatggagtccatgtgtgtattttgcatcctctgtaaatatggccgtagagtacattctaaacacagcctttctgatccactggcttttgtgcataccagggtatgacatcgtgttaaaaagaccgttagtgtagtgtattgtttttgtaaatgcagtttattctaagcacactatatgctggaattatttctagagttcatagtggtattatcattaaggtgtatggaaagtatactaattcctattctataggcaaaaacaactggagcacagcaatactactgccttattgaatcttataagaatatagggggaataatacttgaagtgtacaataataataataatatgctcaaccagcaacactaattaccataagaaagatgtggttgagaactacatttccacaataattacacaattgctacactcacttggcaaccttatggtatggctggtatgctagcaaccaaatcttcctgtgtaaaactacttccatgatgttcctgccacaggatttcgtgctgggctgacagaacagaacagtttcctgaggaacgttttctttttctttcttttcttttctttttttttttttttagacatagggtctcgttctgttgcctaggctggagtgcagtggcaggattatggctcactgaacaccttctgggctcaagtgaccctcctgactcagcactctcccccacccccacccacacccccacccccaccaagtagctgggactacaggtgcccacatctggctaatttaaaaaacttttttttaaagagatggggtcttgttatgttgcccagggtggtctggaactcctggcctcaagcaatcctcccacctcaccctcccaaagtgcaggaattataggagtgagtcactgagcccagcccccaaggagacttttctgattgctggtctttgccatcctcagagaaccaggcggggcacccagggtccctctttgttgactcataccttgggttctcttatatttactcaaacataatgtcctgaagttatcagtagtcccttcttattctccagctccctgtaaaggcttaaagcataactctgggaaaatgttttgcttgggtgggcagaaatggtatatttgggtacagatgtgggatgtgaagcctcagctgtcactgcacctgcacccagagtggtccccacttcttccactctttgcatctgtcctgggcaccctcctttatctttgcacaaaggattaagcatttcatgtgatatgccttaaattgattttccttatgagtagggaaagggagtggggatagaagacaattgtttaatccaataatcatgcaagaatgtgttcttgacattaagagaacaactgtagtctgtggagtagcctaagacacagttgcacatagctatgcaggcagttattgatctgaagaatgaaccgtcatggctgctttgaggaataagatgcatcactattgaaggaggccgggagaatactggagagtggtctccaaccctggatcttgatgctgctgtttactgcagccatgcaaaggaatgtgtgcttcaggtctgagtgttcaaggcaggaccagcaaatttccatgaactctctgaccgtaggccacctctgttccattttgcttctttgctcctaaaaaaattaaatatcttaagttagtttataaaacattatactttaaacaggaagtgaaaatgtttttctgtttttaaaagtaatatatgccattgtagagaatgtggaaaatacagaaagattcagagatcacagaattaagaatccaaatgattttgaccagctggaatgatcaagtctgaattagcatgatgatatttaaatgggatgtgttttgctttgacgatttcggcttagggtcctcggagagagaagcctgtgtcccttaagcctagcaaggtacttggcagagaagggcagagtggggcattcctgaatgaacaaatggatgaataaatagaataggatgcatggaattaaggcaggactccctgtgttggaagcaaagctaggagtcacaaggagaacgagcactcaaaaaagagatttctcagcaaggcaaatttacttctgcagaagggtgcttctcacaggactggttgccacgagagcacaccgaacacaggagggaaagggtttttttcattcctaacgcagcttgtccttactgctgtgtcctgcctccattggctggagttggaccgcacaatctaaactgaacccgattggctaacttgaaagacaactttggcgggaagagctgccacagcaggaggggtaaattacagagtgagtagcagacgtgggctctgtagataaggacttacaagggacttacagtccggtgaagaactaaacagcaatggcatctaataaatacccaaggatgagcagttggtttcatcttcatactccctaaggaccggtgggagagttgtttactggacccggaagaaacatgatagaatttctggggcattcactttggaggaaaccatgggatggtctacattgaaggcctgaggaacttttccctcctccgtgctaagttggtagtttccactttccaccacccacttcccacagctccccccaaacacacgtacacatcgtttttcacaccatcatcctttttggtaaagagatgtgtccatttctgtcctgcattagtgagttccttaccaggtgcaaacactgttagatgtcctgaaaaatgtatctcataaaagagctgtagcaggagggagtatcagagaagagagtagctttccttttgctgtctggctgcaaaaccatctggaagcccccgcggaggtgggctgtgtgcccgagccctaccttggagagacacttggttcccttttccagcagatttcttttcctgacagataattctctgttaatcgagggctcctcaaatccgaatctgagcttcctcttctattctcacctctgtgccagggaaattttcttggcaattgaaaccaaagcgataggctggcagtgggactctacttggctgggggtaaaataagcaatgattgcacataattgcagaaaacaattttgaattttattaatgaggtgctccaaacaacatcttttagtccattgtcccacttaacagccaattcaccggagttcattgtgctgtaatttacatctatcttcccccattgataacaccaggcccttgtgttctgtaattgacacaagttggtcattttcaggggtgtttctctctctaaggacataaaataaacaggcttgctggcgagtgggattgagttagcctcatccacagagccaattggctgctgctgcttgacgctcattttccttcctcaggagaggtggcacagccgtgggtacgtgcacagaaagtcctcaggttaaagatgttgaggtggaggcctggggaggcaagcggatgtcgatagtgagaaaacgagacttctttgcctttcctttgcttcttgccacccaggacccaacatctccaggtggagctgatttttagtgtgcgcagccaggctttgggggcagtagaggtaagattcaggggagggtttccaggaggggatataggccaccacctccttcagcatctcatctcaaaatgtagcatgtgtgagtcgccactataggtcccagtgagctcagctagcccagctcctaccttctttgtgtgtttacagcaaaaacgctgtcactgctttcatgtgtctgtttaaacactgtgtggccatcggctctgtgttgggcacttagggagtatgaagatgaaaccaactgctcatccttgggtatttattagatgccattgctatttagttcttcgccagactgtaagtcccttgaggtcaaggatctcgtctcctctgttcttagtatcctctatagaaccgataacagagtggacacttagaaaaacattaacaggccaggcgcagtggctcacgcttgtaatcccagcacttttggaggctgagacgggtggatcatctgaggtcaggagtttgagaccagcctggctaacatggtgaaaccccatttctactaaaaatacaaaaaattagttgggcatggtggtgtacacctataatcccagctactcaggaggctgaggcaggagaatcgcttgaacccgggaggcggaggttgcagtgagctgagatcatgccactgcactccagcctggctgacagagtgagactacatctaaaaaaaataaaacaagaaaaaaaataaaaaaagaaaacattaacaaatggatgaatcaaatggagaagaagagacaagtacagaaacacgtgtagaagtggaaaagaaaaaacaaaaacataaagggagctctaaaaggttacagaaagagctgtgggacatagagagaggtgtttcttttccctggggtgagccgggaagccttcatggaaaggctggcctggagcatgagagattctcatcggtggacggtggaggttgagcatttcaggggtaaattccgagaacattgtacacacataagaaataatgcaaggtgcctatggctttgacttgagcatttggtatgtgcaaggaagtgactggagatcaaaagggaaatgcagattggaaacagggcctgggggtcttgtggcagcttgtgggtggccatgctttccctgggcactgcccgacccaggggactcagctgcgggtggcacgctcggcgtgcaaggcatttgcttactggaaactacacccgtaagaagatactggggtcttgggaaggaaggtgactgttaacctgtgggggtcagcttacagtgtgagtgttggccagaatgatcaagctctccagccttagcccagatcaaaatccagaggccaggaaggatgtaagcctagctctgtgccatgcagctggttggaacagaggtgcagatacaggctccacccctctgggaccatcagctcccagggtgtctgcagcctcacagcatgactctctcccagtcagcccacccccaaggccccgcagctgcagcttctgctgtgctttcattccagggatgggcagggtgacatcaggccacccgcagcctctggcctcagcctctctgcctaggtggcaccatgggctccaaccagccggggcagctgctgggaccaccccgcacaggcccactctgcagtgagggaaggaccgacaggcttgcggctgctggattactcagtatttttcactttaatatcctaatcctgaagttgttctgcgatgtggtgttctggtggtaaatataatcttttggcagagtttttgaactgtctggaacccaatatcctaagctttttttttttttttttactgtatttggattatattgtgggatttttttccccaaggaggaaaaaacgtattttaaaatacaacatgaagtgagtgaaaaaatttgtttaatgcaaataaaagaattgaagctggagggtgagtgtttccagaggaggccatcaccgtaggaggagaagctggactcagagccagggagtcccagagcctgtggtaggccctgtccttgtgtggggagatcagccagttccaagtgcagggaccaaggacattcccaagcccgtcctcagccagctagtcctgcagggctgttcggagcatccaggtcttctgtcattttttcttccccagacaaacctcctagacataggaagccctttcagaagacacatttgcctctccacagctccacccattatcctttaccactggcgatgttctgttcttcttgggacaccacagcgttatttgtctttccagaccaaaaatatatccctcaggagtatggcggtttttaagctcacaccaagggaatgcttgtataggccttgtgtcttcttgtgatgtttcccagcgatgggcctgaacgggagagactagccaactgttgctgaacgcgatattcttttgtgaataaaaaggccctgattccagccaaaccgggatctggtttggctgggtgtgggacgggagcagtcaccgcaagatccccagacatgtgtctgagcccctgtgtggcctgaggctctcccagttagtcatggcagtagaaagtctctccctgctcgagatgcaaaagactcaccatccaaagagttgggccatcccctgcccgctgtgactgtctagctgtctgccccttgacagggcccaaaatgatccagtgctggaggccggctttgcaaacccaaggcagggtctcactgtgttgcccaggctggagtgcggtggcccaatcagctcactgtaaccttgaactcctagactcaagcaatcctcctgcctcagcctctcaaggagctgggattacaggcatgcaccactaagcctgactcatttctttactttttgtagagatggggtcttgctgtgttgcccaggctggtcctcaattcctggcctcaagtgatcctcctgcctcagcctctaagagctctgggattagagatgtgagccactgtgcctggcctcatgataactttttataaagaaaaaaatttaaatcctctgtttcttctcttcctcatcttcccttactttacccacaaacaggggaagaactttctagcaggaaccatttagttctgtcttgggagcacttgtttccttctcagtttcttagaaagtgcagagtctgcttgctggcaccgcaccgtatcaaatgcttgtgatttccattcggcctgcacccacggcagtgggctctgcccgactgctcctcagcgggggcctgggagggggctgaaaagcctggggctggtgggaagtggtactccctccagcatggcggtttggagtcttgaggaagggtccccccttagccgtggcccagggacactgcccctccccacccccagacccttcccgacaacactgcctgcttgggatgctctaggcagaagtgggcggtggggctggcctccatttcagtgcttggtaattttacggttggggtctccgtcttagaagcaatttcccataattccacttgggagagaagtgtctttattgctcatccccattttaaaggtgggtaattgggggcctcaagagattaggagtcttgctcatgataaaacaggaagtggtgggtctgcgatttggaattctgcgttcctgcaggacaccctgccgcccgtgccacctgttctctcccacgtgatgggcgcaaacccctgagaggtcccttttcagctcttgctccattctcagctgttgtgtttccctctccagatcccccacattgacacaagagatgtgatgcctccgggcagttaagggtgaaaagcgaatgcaggttttctctctcctctttgcccccaatcctacgggtgaatgaggcttgcatctctcttttgctaccatcgagagcagcagctcagtcagctaacttccgtttgcctgccggcatgagttcagcgagtttccccttggttttagagccaaagcctgagcacttggtgtaactttgcgtgctgtcgccctgagaggcggcaccgtcgggccccgagtcagccgtgtgctcgaaccgccccactttaccattcctgttcctcaccggtcactctttagtagagtcccgtccacttaaggagcacttcatacccatgaattgagtaaaattattttacagcatatggcatttttcatgactataattacaaaggattctagacgtcattgatgggggttctccctggcgctaacactgagtgagaagttgacccagttagattaaagctcaagttaataaacagcattcacacatttctaggcctgttgaccaatatcctttaaatcagtgtggctttccaaggggggagcaaataaaaccctaaggtagccagagtgctgttttttccaattaaccttgttcgttttgatttcctttcggttcagaacaatttaggtcaatcttagatttttaagaatgaacctctggagggagaggaaattaactaggccctaagggggcttggttaccacaattaaccccaaaagacagactctcaggctggtggggggcctggagaggggccacatgaccacttcaggccatctgctcacatggagaccctggtgggagtgtcctcttttctttcctgctggctggttaaataaactctgcaggctaccacgctgacgaagggtctgcccatttctcatgctccttctgtcttttagccaaagctgtgttccctctctttctgagaagagggatcagcaaacccttaactcccagagatcgctggtggagttcagggatggaagtgcctgatccaggcagacctaaagcagaggtaatggaagagagatgggaggacagagaagaaaagaagggcgtggggcaggaaggcagggccagactcctttctgtgttaggagcagagccttccttcaccggagcctgggcagtcaatcaccctgagagcgctgggagcctttcatcatcatcagaaggcgttgtgcgtggtgtggatgcacacgtgaccgtgtgccgcacctttgttctgcccgttccttactccttatttaggtgatgaaagatgtggtgccccaactttaagttccacttgacgcagaatttcctgattgaggatggagcctggggctaccttgaggtaattacgggatagtcgttgtacctggaacgtacatttttctaaagttgccacacagtaagactcccacagttctgtccacaccccttcccatgacattattgtttcttcaaaagggaccagccgctgagattttgttagcagggaaatctgtttcacaggaaggagggatgtgtagatgggacctaaacatcgaagtttataatttggtgaaaacctgataaatgggaagaccatttgaaatagatgtttcagtggctgggagtcccagatacccttgaatttaacactgctcattacatacctcagtgaccagaaattggagaccagcctgggcaacatcgcaagaccccatctctacaaaaagtaaaaaaaaaaagagtcaggcttagtggtgtgtgcctgtaatcccagctccctgggaggttgaggtggaaggattgcttgagcccaggagttcaaggtgacagtaagctgattgggccactgcactccagcctgggcaacactgtgagatcctgcctctaaaaacatttttttaatatcatcataaactctgtcagaaatacaaaggagcataaagaatgtaacaaacaatctgtatccacaatctggcctaataaataacacattaccatcccatttgaaggctttttgccagacagagggcaagtccttgagcgggcgtccagtgcaggtgtgctgaagagcccagcctcaagcctaaaatgggatagtacaggacatgaacatgtgaggcaagtggatcacctgaggtcaggagtttgagaccagcctgggcaacatggtgaaaccccgtctctagtaaaaatacaaaaaattagctgggcttggtggtgcgcacctgtaatcccaactagttgggaggctgaggcaggagaatcgcttgaacccaggaggtggaggttgcagtgagccgagattgtgctgttgcactccagcctgggttacaagagcaaaactccgtctgaaaaataaataagtaaataaataacgacatagaagacagaatatggtaggcggtaaaagggaaatgctgagcagcagaatgagagtagtcagagttaagaagagggaggcatcttgggagatcggctgaatgagggcaaacttgatgaaggaggtggcatgtcagttgggccacggagaacgggtaggattatctactttgttctgcatacatctccctaacccttcccttaagcttctcttccaaagtttctctgggaagtttctctttcccttcccagactaaagctctttccctgctgtttgtcctctcttgcttggctcaggctatgatggaaaacgtcctcaggctgggtttctgggtgccagatggcagccaccatgggaggaagggtggccgagtactctcagggcccggctccttggtgaccagccaggtgccctccagccagcggccccagcatgacacggtccaggtaacctcccttcaccgtgctattgggagggtgttttccaggactggtgtgaagtagattcagttcccgagaaggacagagctgcctgatgcgtgaacaggcctctctgagaccagggaggccacagctctgagacatgaagcagatgctgctcctcagggcctgtggagagagaactctaccctcttccatttctgaaagccagtggaggcttctcctcctctggaggattcatttcatttgttagttaacgcatccattccttcaacatagattcattccatgtcagctctgccccaggccttatgctgggctcggggtgtggaaaatggaatcgaagctggtctctgctcctgagaggcttacagccccttttagggtatgtgctggatctggaaagctgggatagaagaaattgggtgactgtgtattgtctttgtgcttttgtgtttttttagaggcttctatgatcagaatatttttggactaatgatgtgagttccttagataatttgaaaatgtgcccctatattctctactgtttagagtggtataatgttggcatgacctcatcttcctttcaagattacatattaaaagaaaatttgactttatattaaacgaagtcaaagctgggttcagtggtgagcacctgttgtcccagctgctagggaggctcaggcagaaggatcacttgagcccaggagttcgagtccagcctgggcaacataatgagaccttgtctctaaaaaaaaaattaattaattaaaaaataaataagtaataggaatcagaccccagcatcatagttgtgcatattacctgttatttctttaagagatatcccttctccttgagttccatttttatgggaattacttgctttaaaaaaaaaaaacacacacacacaaaaacttcaaagatacagcattgacatgacgataaacttccatttctttaaataagctccttgcaacatctgatgtatctgtaacaaaaagaagggcaggagaaggagcttgcatttatgtttatgaacagggtaaactcagagacttgcaacctttaccccgccctcccccaccccaccctcaagaagtcccgaagaacaaaaggcaattcagatggcagaatattacttctgttgctgtagcaccaaactattaaaaataaaactgtccctcaaggcaaaacatttcatttattttcctttgaatgagtaacttgtttattaagatgaactaagtggctaaatctagatggtacgcaggcaagaaaaattgatgtattgtagcctttcggaaagtatgctttatgttccctggaatcatctctgggttttaaatgaagaagagctcgtttagtcagatggggagctgctctccctggaaataggcatcacccggctctgcaatgtggaatgtcatatttgaccttggttctttcgcaaattggttctttctgggctaaatcagtgtgttgaaagagttagctaggtttagtgatcttcaaaggaggaccacgttcctgcctcaactgcgtctgcagttttttgaagtgtttaatataaaatcgtttcacttttgccttatttcatatttgagatcactgtgctactgcatctgttagagaggcaacacagagcacagggagccaactgcagtccctggagcttctgagagagctccctttgttgcttcctgacccagcctcagaggcatcccgcccacagggaaggatatttgtctcagcagggaggttccccattactgtctcctcatctggggacacaaatgtgatgtccaattcccctctgattgaggtctcatttgccctaaactaatgcaacttgaaaggagaaaagggtgtcaatggttaaaacaacaacaatgacaagaacaacaaaaacctccacccaatttagcagtgaaacaggaaacgccgtattgaggagagaagcttttagttggaaaaaaaatttctctttagaatttggacaacaaatgactctcactctcttttctggtggtgattgttttatttgttaatttttttttttttttttttgagacggagtctcgctctgtttcccacgctggagtgcaatggcacaatctcggcccgctgcaacctccgctgctggggttcaagcgattctcctgcctcagcctccctagtagctggcattacaggtgcccatcaccacgcccagctatttttttttgtatttttaatagagacggggatttttaccacattggccaggctggtctcgaactcctgacctcaggtgatctgctcgcctcagcctcccaaagtgctaggactataggcatgagccactgcgcccggtcgattgttttattttaatatcacgacacacatattattcctgatttgtaatctcacgatacccgccttgctcgccaagagtcctgagtgctggcctggtaaagatgattatctccatctttcagacgaggaaaccaaagttcagagcacaggtccgcagaacagtcacagctgccagcagttgcacacccacatgcgccatcccatttgatcatcaccaacctgccggttaggttttcttgtcacccgaattttacaaaagtggaacagaagcaccgagagaataaatgagctgcctgagattcatcaactgctggtggaactgggcttagtcctgcattctttccaaagcccccatgcggtgactcagtatttggccatttttctttatcctttttgcctggtgactctgaagagagcccacctacagtccagcatgtctggatcctgtgcagcgggcagaggccagaggccatggtgggggccccagaactcaggctgggaatcccaggggctactccagctttcatgtcaccagagcagtgacattcgggccctcgggggcagactgtgcctgtggcttctcagtggggtgccttagggtcccctcagcagatggatcccatctcctggtctggttagcataagataaacagggatagtagcagcagttgtcactctgagggagggaaggggaagggagggctcaggtgaaaagcagaagggaactctatggctgtctttcttctccctgtttacctgtccacccatctgagagataaaagaagagcagaggagggtgagtgaggaaaaagcaggagggtattgggtgtggggccgatggttttcactcaatccgccgggagatctgaatatcaactctctatggaagaacaagaaccgaggtgtctcttctgccccatttctagcccagggtgaccccaggagctctgcagtgtgccgcatggaatcgcctaagatgggactgccttggaacaaacagtttcaatgtctatttcacatgtgcgctctagctcagaattttaataagcaaatatacatggtaccttgccgtaggggggctttatgtttctaaatctatgaattaataaacaggatgagcctttttaaaaaagggagcttggggcagaatgaaccactaaaaagttattggctcttaactcctgctttttgtagaagcttgacaggcagctgactcagccagacctgaaaccctttccccggttcttgttggcatttctgactttgccatttcagttggcactgacccttccaagactgtgtatgccaggagggagcatctgcccccatctactctctgggaagatgtcctctcccaagagtcaagagtgtcttgttctgaccgtgggttacttctctgtgtctgtctgagaggggaaagcattgtcatcacacaggaggtagcaaatacctacctctttttttttttttttttttttttttttttgagacggagtcttgctctgttgcccaggctggagtgcagtgatgcgatctcagctcactgcaagctttgcctcccgggttcacaccattctctcgcctcagcctcccgagtagctgggactacaggtgcccgccaccacgcgcagctaattttttagtttcaccgtgttagccaggatggtctccatcttctgaccttgtgatctgcctgccccggcctcccaaagtgctgggattataggcgcgagccactgcgcctagtctgctctggtttctaatagaagtaggtatttgcagctaggcgcggtagctcatgcctgtaatcccagcactttgagaggctgaggcaggcagatcgcttgagcccaggggtttcagactagcctgggcaacatggagaaactccatctctacaaaaaatacaaaaaattagccaggtgtggtggcacatgcatgtagttccagctactcaggaggctgaggcgggaggatcacctgagcctaggaggtcaaggctgctgtgagctgtgattgcaccgctgcactctagcctgcgcaacagagtgagatcctgtcccctccaccccaaaaaaaagaaaacaaagaaagaaaccagaacaccaggtgtgtcttcctgagttttcaccctgatcactgcctctcctgccagctccctgctttccagggaagagttggctgcgccaggggacagagcactgactcccacccaggccactgggacagccatatctaggcctcaaaagactatgggggttcctagcaaattccaccttatttgacttctccgaacagcccaaactctgctgggcttcttcccttgccttcataggagacttgatgcagggggcagaggtgagagcccagggggacagctggccttcaggaggggtccttgctgggtgtttccaggagagcttcggcctctctctccgcaccatgttccaggtggcgttgaagaccagtgggtaatttggggggtgtgggaacagaaaatcagaggaacagctagtgttttcttccttgagacttgtttcccctttgacagtttagatggatagtaacaataatcaccgataggaaagtcatcctgactggggtctgaagccttccgtggatgttcccgtctaattctcacagtaaccctgtgggcttttaaggtaagaatgatcactgactccacttttcaccagtgtcggaactgagacttggagaggttcagtgaccagacgatggagtccagggtccagggtccagggtccagggtccggggtccagggtcttcacagcctgtgctccctccccttccgtttctcctcttgctttgggtttgggaagcctccgcggggtgaggtggagagtgcgcctcactagtcaggcaccccgaaggagtaaggcatgtgactgtacaatatcccaataaagcgtgtgggtggtggggatgggtgggcgaggttgagatccattctttaaggcattaaatactgtctctttcaaaaggaggttgtgctgttttgcagctggttttctttaactaccagaaacaccagcattgtttcagaaagccacagaatttccaaacacaatgagaattccaagaggatggggtgtgggttttgggggctggggtgggtatggacaggcttttggggagggaagaccacagcctgagtggttttgtcccccacgggtaatgaatttcacacggctccactgtcctcagttttatctgcaggatgctcaagttgaagcctgggaaagaaggggatcgggaaggagcaggccccagggattacagtggccataaaaaccaaacagtgacccaggacagccccatttggtgtgacctctaatgactgccttccctcagctggtgtcagaggaggcacatggtgtcagttaagttccaaagtgacatttgtataaataagtttgttaatgggaaatgagtttttttttctccctctccaatcttaagaaagtgtgtagcctatatccaaatatttctgaaagagcatcaacagtaacggcaaacaggggagctaatgtcaccaacaaaacttgtgaggtcaacccaaagaaagaagggaataaatgagcaaaactttggaaagagtttctcacatgctgaaaacactcagcaatatttctaacaagcgtggtggcccttcagtcagaagtggcctttctctgaagtttgaagtaaaaaaaaaaaaaaaaaaaaaattctgttcttcctgcttttttttttgagatggagtttcactgttctcacccaggctggagtgcaatggcatgatctcagctcactgtaaccttcgcttcccctgttcaaaccatctcctgcctcagccacccaaatagctggaattacaggcccctaccaccacgtccggctaatttttgtatttttagtggaaatggtgtttcaccatgttggccaggctggtcttgaactcctgacatcaggtggtcagcttgcctcggcctcccaaagtgctgggattacaggtgtgggcacaccgtgcctggcctattcttcctactttttatactttgtgtttgcattcaacttgacaaactcaggcagccttaccagatagcttggtatttgtgagattcagttctgagttttgaagtaaaattttaaatgtgattgtttttatcctttaaagtatagagaagtcaatagccttggcttctaggtctgactgactgttctatggataatggatatggataatgtgaattggaatttatatccgtggaatcaaacatgttcaactgcatgacatgcatgacagaaagtggcacttggcagagacagagagggaaacagtcattctcccgagctgtgaagagtgcaactctagagtacattctcagttcttttatctgtggaggaaaaggcacgttgtcatggttaagaaatatcacatgccaacttagtgacgggggaaagaccctcttaacaaatggtctgggccgggcctggtggctcacgcctgtaatccagcactttgggggctgaggcaggcggatcacctgaggtcaggagttcgagaccagcctggccaacatggtaaaaccccgtctctactaaaaatacaaaaattagccaggtgtggtggtgggtgtctgtaatctcagctacttgggaggctgaggcaggagaatcgcttaaacccgggaggcggaggttgcagtgtgtcgagatcgtaccattgccctccagcctgggtgactagagtgagactccatctcaaaaacaaacaaacaaacaaaaacactaacgtatactctagaggcttacacaattaattgtagaaaatgaaactctgaaagaactagaagaaaatataggtgaatttttatctaatctcaaaatagagcagccttattaaaatacgacagaagggaagcaaaatcaataaatgagcctgaggttgaattacagattacttgtacaagaatattcatagcagcaccacagcaaaaccttgaaacaacccaaatgttgcatattgagagtggataaacaatagagtttttcacacaaaattttcaaaaattttaaaaacaatacccccaaatcgacaaattgtaatgacatataatcctatggctaaactttacaatataatattaagtgcaaaaaacgttacttaatacacaatagcctttcttaacccaatgttttaatatgaaaaatttcaaacattcagtaaaactgaaagaattttctcgtgagtacctgtatgcccatcatcttgtttatccctttcacactttgttatgtttgctttctcacatactcattcattattccctctaattcagcagtcctcagcttggggtgattttgccccccaggaatatctgacagtgtttggagacagttttagttgttacagctgggatagggtactactgacatctggtgtgggtagaggccagggacgctggtcacagcctgcattccacatggcaagcccccaccacagagaatcagctagccccagattgcagcagtgctgaagctgagaacccctgctggaatccatcttattttctgatacatttcagagaaacctggattcactggtatacttcctcctacatatttaagtatgtatatcattaactagatttccatatttatttacagtgtttttcttttgatgtgaaatgtacatgcaatgaaatgcagaagtcttaagggtacattcactgagctttggtcagggcatgcacctgtgtaacccagactcctgtcaggacagaggaccttaccattggcttagaaaatcccccttaactcgtctccagtcaagcctttcagcctcctttccccaggaggcaacaattattctattttttttccaccatagaaaaaagttagaacagtggttctcatagttttgtgtgttttagaattgcatataaatggaataacaacagatgcacgctttgtctgagacttctttcactccatagcacagcagttctgcaagtgtgttctgcagacctcttaggttctccaacactccttcagggggtcccatatgtcacagctattttcattataattctgagacatttttctcctctacactgtgctgacatgtacgtagatggtgcaaaggtaacggtgggtaaattgaggcagtagcaccaaactgtacctttgtcagtgtgttcttcatcaccaccaacttacagaaaaaggagtcagcatcacttaaaaatgccctgggtgaagcagaacagatgtgcatctttttaaatctcagcccctgaatacatgttcttttaatattctgtatgatggccgggtgcagtggctcacgtctgtaatcccagcactttgggaggctgaggcgggtggatcacctgaggtcgggagttcgagaccagcctgaccaatagggacaaaccctgtctctactaaaaatacaaaaattagccgggtgtggtggcgcgtgcctgtaatcccagctactggggaggctgaggcaggagaatcgcttgaacctgggaggcggaggttgcggtgagccaagattgcgccactgcactccagcctgggcaacaagagcaaaactccgtctcaaagaaaaaaaaaaaaaattctgtatgatgtaatggaaggtcctcataaagcacttccactccaccgtagtagcacgattgtcttcaggaagggcgtatacgcagttgtttgagttgccagccaagctagctgcttttctcatggaacaccatttttacctggaagagcaactgaccaactacagttattcaggtttgcgtatgtggcagtgaagctgtcacttcaagggaaacagctgacagcatttgttgctattgatacaacttgaacttgcaaggaagaattagaatttttgaaaacttgtatttgtcaccatgaacttgagagcttcccaataactaacaatttttctgacaagattggtggtgatattgacatatgatttaaaaacataatgacatgcatcaacatttgcaagatatgtataactcactgaataattattttctaaatgacctgtgtaggatattatacagttatacacaggtaaaagttccattccaactgtggcgtagaccaatggatttccatgtagtggagtagaaaaagtttactgataacggtttcagggcccatattgcaactaacctttaagaaactaccacttttaaagttttggtttgtatcaaagatgaatagccataattatctgaaaaggctattaaaatagttcttcatattcctacttcatatctgtgtgaggctgagttttctctatattctccaaccacaaaaacttccagatgagtttccaaggtagtttacaccattttacacttctaccacaatgtctgagactataatagcctttttacaaatttacaacagcaaaacacacaatttcagaattcatagagatgagatactactgtgtaaaaagcaaagctggggactgatacccacaggacttgaggtggcagtaaccttgggtgggagagtcctgcatagccagatgtgtacctggtgaagggccagttaaagcgctgttgtttaaaccaaggagaagggtcctgggggtgccctttgccataggaaactatttcccatagtattagtatctgtggctaacaacatggccacaggctgtactttcctgtccaatctctgtgtatctaagtctgctgaggctgcagattcctgcaaagagcagtcgatggccctctgcaggagggctgatggagaaaacatgcgtcggatgcttacaccggccgtgtcagagaagaggaatgagcctattgctcctgccatgtaatgattcctgttgggagtcagtgactccttttctgtggggctaccctcacccatccacatttctggctttccttgctaggggttcttccctcgtcttccaagtcctgtgcaggtggctggaggccagagaggactcatttggctataatcagaggcattcccctttcctcggtccgtagggatggaagggtttgagcccgagtttatttacccttagcaaaacacaactaggttttattattattattattttagtgcttgggataaaaaggcccataaaaacaatagcataaaacagcttttactgatcaaacgtcatgctgatttatttgtgagtgaaatctgaaccatatggtctggcttcccttaaaatgcacagggggttcaggattaagggaacaaactcttggcaaatttgttttgcgtttcactgagcacatcatgttagaaacaaaatagagcaattgttgagtgcttactgtgtgcaggaaattgtgcttagtgattgatgtccatgatctcgcttcatcttcacaacgatccatgcagtcagcagcgttccccacgaggggcagcagcagtgctgagctcagggccctcatgacctgcaggaaggtgggcaaagtggggaagatctggaatccagtggggaagagtcgtccaccagtgacagcacttccacctaaagtcccctgatcgtgaaagagatgaaactgcaaacgaggacgtgaacttggggcctgtggatcagctggccttctcaggttgcagagagccagctgtgcattgtcttattcccttgtcccagcagagactgaacgctaagtctttcccaccatcaaggcatgaggtttctctctttgccgcatttgtgttgggcatctcagccctcagtctgtattcttgtggagggtgcacctctttttttttttgtttttttgtacacacagttttgctcttagttgcccaggctagagtgcaatggcgcgatctcggctccctgcaacctccttttcccaggttctaagcgattctcctgcctcagcctcctgagtagctgggattacaggcatgcaccaccacgcccggctaattttgtatttttagtagagatggggtttctccatgttggtcaggctggtctcaaactcccgacctcaggtgatccacccgcctcggcctcccaaagtgctgggattataggcataagccaccgcacctggccagatgcatctctttgagtttgggaacgaaaagggtatgatggcagaatcatgtgctgccagtcatgatcacagtgatgttcattctggttcctgggcttaagcttctaatttgctgtaagaaagctcagtgggcttgccctttgcctaagtgaaaccagcttatttccacttttcttcaggcaccctcacggacatccagtgccacggtcctgctttgtcaggcagcatctttcagattcttgaaagacaggcagcttgtttcgaatgacccacagggaatggtgcaccattcactcagtccacccctagcacgggccagtcctatgtcgttttttggcatttttgaggaacagctcccttttcagtaccaggtgacattattacccagatccagttgcggagaggcgtgtgtgtctgtctggttgagctgaaacgtgggcagatcagaaaggaaggaaaactggattaagccaggatttgcttacctggaaggtccagaaagaaattccccttccttccacagccagaggatttcaagtctataatgttgctaaaattagcagtgtaacaaaacttcccatgtgatgtagcacaggttgatggggtaagccagtgtaacatggaaacccactggcacctctgcatctgggcctaaggctgcggcctccgtcctcttcgccatcattggcctctcttgtttcttcccacccctgtcacaccgcccttgaccatggttgtctgtcatgtggattcctcacgggcagagatactaccctctgagcttgctccctgctttgctctggagtgtggaatttaaaacttgtaatgataggagaagggaagaacacagttacagtattagactcactgtttcctgagccactaaatgtatcagactgttatatttgggttattttccaaaaaccttttggtagtcattaaaaaaacactctgaggctgggtgtggtggctcacgcctgtgattccagcactttaggaggctgaggtgggtggattacctgaggtcaggagtttgagaccagcctggccaacatggtggaaccccatctctactaaaaatacaaaaaattagccgggcatggtggcgggcacctgtaatcccagctacttaggaggctgaggcaggagaatcgcttgaacccgggaggcggaggttgcagtgagctcaggttgcgcctctgcactccagcctgggcaacaagagcgaaactctgtctcaaaacaaaacaaacacactgtggctatatttattcatggaaacaatgatataacattcttagacttgccttcaaaggccacctgtattaatagggtcccacgcatgccacttataacatggattctgtagcacattgggacatcggaagccttctccattcactctcccttgctctccctattgttccagcacctcctgagggggccctctttcaggagctttgatcattccctgcacttgtacatttccataactagcaccacctttgtatctagatgtttgcatgcaaggggcatctccaggtatcttcccatgtatccttagttgcccaggcgggcggatcacctgaggtcgggagttcgagaccagcctgaccaacatggggaaatcccacctctactaaaaatacaaagttagctgggcctggaggcgcatgcctgtaatcccagctacttgggaggctgaggcaggagaattgcttgaaactgggaggtggaggttgcagtgagccgagattgcaccaccacactccaccctgggcaacaagagcaaaaactccatctcaaaaaaaaaaaaacaaaaggcagtttccgcagttgtaagtaggactagaggaaagagtgatgataatattgataacaataaaatacaattattgagtgcttactgtatataggagatacacttagtaatttacatgtattatctcacttaatcttcgcagtaatctgaggagataatgttaccctcattttgcagctgaaatgtagcaggttgcttcacccctggaggctgcacgcctagtagtgatggagcagaggcaggagcctagcgtcacctgactccagagttcattctccaatcaccgcatgatactgactcctaatcgtagcctgatggctttaacaagagaaaataaggttaccttccagctagagggatttattattattattattattgtatttctttatttattttgagacagggtctcgttctgttgcccaggctggagtgcaatgatgcaatcttggctcactgcagcctccgcctcccaggttcaagcgattcacatgtctcagcctccctagtaggtcagactacaggcacgtgccacgatatctggctaatttttaaaaattttttttagtagagactgggttttaccatgttggccaggctggtcttgaactcctgacctcatgtgatccacccacttcggtctcccaaagtgctgggattacaagcgtgagccaccgccccctgccggatttatcttacccatgtgtctctgacaggatatattgtcaaattcccaaactgtatttttaggggggttgcaaattttgcttccaaatgatcttctaagagcaggatattctctgcctggagtgatgagggtaccatttctaaaagaggtacattgtagttcaaactcctgcaggtaaggagccgtgacttactaactttcaactttgacacattcgcaggtaagagcagagctacgcactacagcaaaatccaggctgtccgtcagcagctgatgtgcccggtaccttttgtcttggccatcctgttgttcattaatctgatgtatactcactgtgtttgcgtttattttcctaacatttttagcctcatcctattcctataagtgacaggcactgtaactattgaaagtactgattaaaagtagtgtttgattattctgtaagcaaagtaatactttggattaaaacaaagtgactgtcatctgaatcttaatttctgttattttccaaatttctttattcattctcctgttgatgtatatgaagatgaacaaagagagcaaataaaaccactcagaggccgggttcggtggctcacgcctgtaatccccgcactttgggaggccgaggtgggcggatcacaaagtcaggagttcgagaccagcctggccaacatggtaaaaccccatctctacaaaaaatagaaaaattagctgggcgtggcggcacatgcctgtaatcccagctactctggaggctgaggcaggagaatcgcttgaacccgggtggcggaggttgcagtgagccgagatcgcgttattgcactccagcctgggcgatagagcgagactccatctaaaaacaaaacaaaacaaaaagcaaaaaaaaaaaaacaacaacactcagaacccacacctacagtgtaactagagacgaggtgtaccgcagacttggggaaataaatgtcccgaagcagcagagctaactcccagctcccaccaaaaacgatgttacttccaaagatactgcacttgaacaactgaagagagtgctcttgaaataagaaacttagaggcacccaagggatttcagacctatttttgctggtctaagaaaatccaattgatgtaagaatgaccagaaaatggcagcaaacatccataaaaatttgctataaaaagaaaactgccgggcgtggtggctcacgcctgtaatcccagcactttgggaggccgaggcgggtggatcacctgaggtcgggagttcaagactatcctgaccaacatggagaaaccccatctctactaaaaatacaaaaatcagccgggcatggtggcgtgtgcctgtaatcccagctactcgggaggatgaggcaggagaatcgcttgaacccgggaggcagaggttgtggtgagccaagattgcgccattgcactccagcctgggcaacaagagcgaaacttcatgtaaaaaaaaaaaagaaaagaaagaaaggaaaaagaaaacgaaggaaggaaatactccctgaaaacaaccatgaagaaaatgaaaattgttaacaccacctccaacatgaactaaatataattgcacaagcatttaaagaaatgaaagaaaacctaataccagaaatttgaaaaatctcaaacaaaatgctggaaaatgtaaaattaaagattatgacatgccagaaagaaatggaggaaaaagacaaaaaaaaatcatctcaggcatgaagacgagattacaagatgtccattcagattctactgaaaaaaattataagggatattgagaagaggaacgaaaccattcaagacaacaaaaatgagataaagagaggtgaaaagaatcagagaaaaagtgatatataagctaggcaaagaaagtccaacacacaaaattgaagttgaagaacaagcagatggaataaaactaatatttaaaactacaatctaggctgggcgcagtggctcacatccataatcccagcactttgggaggctgaggtgggcagatcacctgaggtcaggagtctgagaccagcctggccaacatggtgaaaccccgtctgtactaaaaatacaaaaaattagccgggcgtggtggcaggcacgtgtaatcccagctacttgggaggctgaggcaggagaatcgcttgatcccgggaggtggaggttgcagtgagccaagttcgtgccactgcgctctagcctgggtgacagagcaagacttcgtctaaaagaaaaataaataaaactagaatccaagaattctttatggaaaaaagaagatgtgactctacatactgaaagtttctacatgcatctgggaaaattgacccagcgtgattaaattctagatgtatcctcataaactttgtggttaaagatgagggagaaggaggaggaggaggataaggaggaagaggaggaagaaaacaaacctctgggcctccagtcaaaaataccaagtcacttaaaaagaaaaaaaaattagattggcatcagccttatcaacagctacgtgcaaagcaagacaaggatggaacaatgttttcaagaaaggtaaggaccatctgaatcaagaattttaaatccagcccatctgtctttcaagtatcaaagttatcgaaaaaaaagttttaatcctacgagaactcagggactactgtcctaacaactccttcctaaagaatatgccagagggttgttaccatcaaacagagagaagactaaggaaatttgtcaaaataactggtggtttgaacaaaagatgcaaaactactttgaaagagggcttcatgtttcagagattaatcggacgtatccatccataagatccttgccaagaaagtttgaataataaaacaatggagctagattgcaatgttttcaccaaatccagaatctctgaagaaattaggatatggctttggcagctctagacgccaaatttgtaaagcaagagaagggaaaaagtgcaagtaattaatggagcttggaaaagacctgaagcaggacagtcaggagtagatgaaagggttttctaagaaaagaagtagaaatgtggaatttggtaaattttattgagaaggcacccgagtagatttaggcttgtagttcttacaaacattaaaaatgttttattgtattaaagagctaatactccttaattatgacttcattatttatgttacagagaagatctagatgcactatttacctccttttgttcctaacctagaaatggtagcaaatacatgtggtttcatttgttttttttttttttttgagatggagttttgctcttgttgcgcaggcaggagtacagtggtgcgatctcagctcaccgcaacctctgcctcccaggttcaagcgattctcctgtcttagcctcccgagtagctgggatcacaggcatgagccaccactcccggctaattttgtatttttagtagagacggggtttctccatgttggtcaggctggtctcgaactcccgacctcaggtgatccacccgccttggcgtcccaaactgctgggattagaggcatgagccatcgcacccggcggtttccttcctttcctccaaagtcacgttgcacatcaatatgtgatttggcaatggttctctttttcactgagccccagtgaagcctcagaattctactcaacgtagcacacgaggcagccattactactctatctgcatttgttggaagttgaaatatatttgctatccctgccctaattgtagggtctgtagcctgattacttggcatcttcatctcacttgtggaaactaacgggattacagacgcactttctcagcaagcgttcattagtcactgagtaaatgacaaacaatgtatgaggctctgggcataatgaaatgattaggacacatttccatcctccaagaggctcacagggcccagaaggaagtgaatgattctgtagaatttgccttgtgaatgtgttactccttaagttatatcgaacattgcagtgatcaagaaatattctactttgtagaaagatcctggaatcacatagaccccaagttttaggcatggcaaaactttatgcacaatttcatatgtaaagtgattttctctgtcctcatccttagtaccttgctactcaaagcgtgacctgaggaccagtggaaagatattacctgggtacttgttagaaaatgcagaattccagtcccataccagatctcttgaaacagaattctcattgtatgaagatacccaggtgacttgtatgtacataaagtgtgagaaacactgcagactcttagtgtccagctagaacaagattgatttgccacctgccacttttctttctccctacacacacttaaaaaaaaatctcttaactaaccacagacacatattccaaatctcatgttctctctgtcataattttcttatttgtaaacttaacatgggaacactattagtacctgtcctgtctgatgagagtgagcatttgctgagatcatgcatctgtggtgttcagtagagtgcccagcttcataaatacatgttatttgtgaatgatatacatgatactagtttaatggaaaattgggacttagaaataatgtttcgggctgggcgcggtggctcacacctgtaatcccagcaatttgggaggctgaggcgggcagatcacctgaggtcaggagtttgagactccagcctggccaacgtggtaaaaccctgtctctactaaaaatacaaaaattagctgggcatggtggcgggcacctgtaatcccagctgctcagggggctgaggcaggagaattgcttgaacctaggaggtggaggttgcagtgagccaagatcgcgccactgcacttcagcctggcctttagaacgagactccctcttaaaaaaaaaaagaaagaaaagaaaaaagaaatttcaacaccgtagcctgttcccagtggaggaaattctgaactttctcgttgttggaactttgtttgatacctctaagtaaatacccaataaaatggtatctaacgcccccctgccgggctgggtggtacccacacttgtacctcgcactcacactcacacacgtcacacacctgtcagggggcacagccccaggtgagcctgagtgctgtgcttgcctcgtggggtgctccatggagatgggtctcccaggcctcagggcttcctgggtgcacctcccgtttctgcgtgcagggagggatggctacaggactgggcgggagaactttcccagtgtggtgaggcgtgctggtgagacagcagtgtttcctgggttacatgtgggcaggactgggttggagatgggcccgcaatttggcctcctgacttggggtgctccagtctgcaggtggaagttcttcccggcggcttgcaaagaagaaaagcgaggagaagggcactgatttattcagcagggcatttccttggtttggctgaaagcttttgacttgcgtgagctcagcaggggagcgccgtttccaggcctcgcaacaccggcctgctattaagtgtttctaagagaataaaagcctgttgtgttaaaaggacttgccctccgccagcagcagtgggcccattagccaatccgttggacacccggtggcacacaggctggctctgcaggaggtcctcctggcctcctgcccctgtgtctttcagaaggcagagtccgtgggagagatctgcttccccatcctcctgcctggtggagctgagagtgtcaactgacactgtcccttcggcctcctcctctgtccctactgcgctgggttgagttgcctgtggaggggctccgcttcccttcctttgtggagctgatgtgttcaggaaaatattcgaatatgttagatttgtataaactaggtcattactctcttgctttaaggttatacttcaaaggccatagttaattaaaggtaggtgtcctttgtcattcaaagtgaacatttgtgtcagttcaataatatttgcttttaaatttccgttaagacatacgggttgggtgtggtggctcatgcttgtaattccagtgctttgagaggctgaggcaggaggatggctcgaggccaggagttccagaccagtctcggcaacatagcaagatcctttccttaaaaaaaaaaagaaaaattagccaggcatggtggcattcacctttaattctagctactcaggaggcagaggtggggggatcgcttgagcctaagagtttgaggttgcaatgagctatgatcacgccactgcactcgagcttgggtgacagagactctggaaacaaagaaaagaaaagaaagggagagacggagggagagaggcagggaggaaggaagggttcagaatatagaaagagggaaggaaaggagggagggaggaagggaataagggttcagaatatagatagaaaggaaaagtccacagaaaactggagtaaagtctgaagctcctgaaataatagtcagtgtgctaagcaggaacagtgtgtacaattttaagacatgagagtgaaataccgggtttgtcatttgcataagtttttgagtagttagaataaacagtgcttatcgccttcccaaaacaccccaccactataagctgcttgtacacactgcatcacttatttttttttttttttttgagacagagtctcgctctgtcacccaggctggagggcagtggcaccatcttggctcactgcaacctccacctcctggggtcaagtgattctcctgccccagcttcccgagtagctgggactacaggtgtgcgccaccatgcctggctaatttttctatttttagtcgagacggggtttcaccatgctggtcaggctggtctcgaactcctgaccttgtagtctgcctgcttcggcctcccaaaatgttgggattacaggcgtgagtgagcctctggcatcacttatgttttaatgaccaaggtgtatacaggtaagaaagttaagcatgtaagtgccaagttcatgtcttggttctatcatttaccagccatgggctttgggcaagttagttttaacctcattcagcctcaacgtcttcaactctaaaatgggaataaatgttgcctccatcatagatttattgtgaaagttaaaggatattgcgtataaaatggcttagcatagttcctgggacgtaattgacaatcaatattataattattaatatgtgaactataggatttttattatttaaaagaacctttaagtgaatttcttataaacctataatgttagcaatgctatgaataaaatttgttttataaggttgaagtttggtatgttgtattttcttgaagcaaattttataatgcatgcgacttgatttttccttgtcctttcctatttttggtaagaatgtctaaacctgaaaacaatggagtgtagaaataaaaatacatgatgcggaatctgagaatgccaatgctaggggaaaggaatactgagtgtgtgtggccgtgagccccgtgggggctgggatttgctcgctgctgtatccccagggcagaacaccatgggtggcatgcagtaggtgcctaatcagtgtgtgttgcttgaataaatgaatgagaccacatagcccaacaccttcattttgtagatggaaacataaggcacagagaagtaaagtgacttgtctgaaattacttaaggccgatctgggactgagtctctggtccgtgtgatcacaaatgcttctaaggctcacaacgtagcagaatttgtctgcaatgaagatcgtggtgtcttcagcagcacactggctggctggttatctctctttcttcctctgtcctctgctccctctttctacttcttcccttctttcttcctcccattcttgcccattgcccctggtggcgtgtcctttgctaaatgagggctagacagatgtaacttacagctctgtctcataccacgcaactctaaagtccatccttagactacgacttagagcagatgtgaatgtttaacctcccttctctctggacatatggcatcatcttatttctctgttagctggtctgccctcctgccacccatttcaaggcactgttggctcctggaagccatctggatggagtttttgtaacgggaaagtgctcctccagcacccaggaagccttgggtgggtgatggtccctgtgatcacccagccgtggtaaggcctgcttcccttgcttagcaaaaccgtaccctggtggatggtgatgctgcagccggggcccagggggtctatgagcatcatggcaaaaaagcctttatgggagctcccagtttactactttcagcctttcggaaacacacacatttccttccattctttactggcaacactgtcttttgtacagactgtatttgtttggattaatacagggagtctgcaaatttttgttcaaataagaatattgtagctgggtgcagtgttccacacctgtaatcccagcactttgggaggccaaggcgtgaaggttgcttgagctcaggagttcagagccagcctgggcaacatagtgagacctcatctctgctaagtaaataagtaaaaattaatcaggcgtggtgacatgtgcctgtggtcccagctacttgggaggctgagatgggaggatcacttgagccccggaggtcgaggctgtggtgagccatgattgcactactgcactccaacctgggcaacagagcaagaccctgtctcaaaaaaaaaaaaaaagttgttatttggccaggcatgctggctcatgcccgtaatcccagcactttgggaggccaaggcaggcagatcacctgaggtcaggagttcaagaccagactgaccaacatggtgagaccccatctctactaaaaaaaatacaaaaattagctgggcatggtggcaggcacatgtaatcccaactactcaggaggctgaggcacaagaatcacttgaacccaagaggcagaggttgcagtgagccgagatcgcaccactgtgctccagcctgcgtgacagaaacttcatctcatctaaaaaaaagaatattgtcatttgagaatcacaaaactctgatctttttaaacataggagagtgatatagagcagtgcttctcaaactgtatttgatgaaggaccagttttcaaattttccatatcgtgttgcagatcaacctatccatcaaagacaataaaaatgaatagaaaaatggaaaaaaatcccaaacccaaaagacattaaaaagtcctcaattttttttattactcagaacaattgggctgggcatggtggctcacacctgtaatcccagcactttgggaggcagagacgggtggatcacttgaggtcaggagtttgagaccagcctgcccaacatggcaaaaccccatctctactaaaaatacaaaaatttagctgggtgtagtggcaggcgcctgtaatctcagctactcgggaggctgaggcaggagaattgcttgaacctgggaggcggaggttgcagtgagctgagttggtgccactgcactccagcctgggtgacaagagcaaaactgtctcaaaaaacaaaacaaaacaaaaaaaccccaattgatctaaaattatacatattgctgcaaaaaattctaaatgcttagtctcaatttctacacttccttctgggtgttggtagcaaactctctgtagacccgactttgaggagctcttgatatggagacgtggtttcttacgtctaatttcgttttccaccatctactgcaagagttgtattttctgcctcacgtcgctgtccttctcccagcccattcattttacttcccctctcagaatggcctgtgtagtgggaggcccaggacatttagtggaagatggacatgggcaggagttaacgcgtcctccagagaatgcctccatgttcttccgtcatccgtgcagatatcaggctgcagtcccgcagaaaatgatgatgttgcacaaggcgaagaagcagatattgacatgaggccaataaaacaggtcatgagccaataaaaatgaccatctgattcactttccagaagagctacgttttaatgatttactagaaagcgaattctttctttgcatcaatttttatcaaaaacttaatgccattaataggtgaagaacacatttttgattcattgactaggattatggttagtaaaatgattttcttttgtttgggttttcattgttgttttagacagagtctctctctgtcgcccaggctggagtgcagtggcgtgatctcagctcactgcaacctctgcctcctaggttcaagcaattcttctgctttggcctccatagtagctgggattacaggtgcccgccaccacgcctggctaattttttgtatttttagtagagacgggttttcactatgttggccaggctggtctcaaactcctgacctcaggtgatctggcctcccagagtgctgggattacaggcatgagccattgtgtcctgaccagtaaaatgattttctgaatgttttagtgtttttccttccaaaagttgtctttcctgacagtgtatttttattttactatataaagagtcactttccggccgggtgtggtcactcacgcctgtaatcccagccctttgggaggccgaggcgggcggatcacttgaggtcaggagtttgagaccagcctgggaaacatggagaaactctattaaaaatacaaagattagccgagtgtcatggcgcacacctgtagtcccagttactcaggaggctgaggcatgagaactgcttgaacccgggaggcggaggttgcagtcagccgagatcgtgcttccagcctgggcaacagagtgagactctgtctcaaaaaaaaagagagtcatttcccgtgaaaaccacgtggtctttctgcatccctaggggttattctggtgcctaacgacttcctgagtccactttcgccgcttccatggccacattcgctttatttttctcttcttaggggaggggaaggcagggcatagttgctgtaatttgtagagttgggttgatcagtcgcaccttagtgtatatacctcagtgtggaaatgtctgaaaattgtaactttgggtttgtagaatttgttttccatttcataagtcctggaattttaaagtcctgcattttcggttcgtttagaggaagctgcatatacacatacatgtacagacatacgagtgtgtatagaatgtggagaaataccactgccctcagactctcgtgagattatatttaatctttttccttctagggaaaatttcaaaaaggtaggagggggctcgtgatatattaacatttttaccaaaagctctgttagggctggaggggagacagcagagaagagcaacaagggaagttttagtgagatatagccatatcagaaaagcaacaatacatttagggaagctgggagaggcaggagatgccgctgtgggagggagctggaaggctacagggacctgccagagggaggctggaggctgtgggccaggtggctcagggaggctggaggaaggtcagaaccagcctggcagagagcctgaagtgacttggagaatgaggtggaaagaaacttgcttcctctgtgccctgagctcaaagataaaggactctggcccggcccaaggtccctgcccccagagtccccgcccagggatcatggatctccaccttttcctactcttgggtctcacagggcctggggattgggaaacagagtattgccaagccttattaagcagctgtttattgggtcagaatacacctgtcaggaaaatcatcggtagtgagcagtttcttcccgttaccagtaaatgtcggaatttcctgagtgcagctctgaaggatttagaggtgtcattcccagagattagcagggacctaatctgtgaagtgaaggtggaatgaccaggatggccagagccagaggaagaccacgaagccagagggtgccccgacagaggaaaagcggccggtgggttttagatcctcatttggccagagggaggcagctggatcggcttctccagagcctgctggctggaggttggctgtccgtggtggtctggttctaagtaggagaagaggtggaacttggagctgggcaccagctggcactgctgtgttcagagcatgggaggaagcagcagcagcagaatcccaggacccccaaagtgggagaagggctcccaggtgccttacaggtcacagtcgagggccttcttaaaagctggcccaaacctgccctttccttgcagcccaatggcctcaggagacagtgactcacgctgtgtccacctgtgtcatcctgtggacagctggaggtccacgggaacagctgctatggcggcggacacagccccgtccagggcccatggcagccccagctggctgcccgctccctcctgtgggcagtgcttcacagcggcagcgggagcactgggtgcagcctctggaaggtctggaaggtgcttgctttggggactcggccctggtggatccccttagcctgtggtatgagctcagtccccatttctcaggtggccttcaaggctcattcctgactcacccagcctcatctccagccattcgagatgcaggcgttgtcattccttgaaattctcacgccttctagatcctctgtgcttttcatcacactatttcctctgcctggaatgtctgtctttgcctgggaaacaaaagagaaaaatgcctgactgttagatttaaaatagcatctcaaagctcacgttatttttaaatatttcaaacacatagataagaatagagaataacataatcccagtgctttgggaggccatggctggaggatctcttgaggccaggagtttgagaccagcctgggctacacagcgagaccctgtctctatgccttccccccccaaaatagggaacatattgaatgtccggcattagcgttatcagatcttactgctatgccgtatgtacttcaaatctcgttttattttaaagaatgaaacaataaagatttagctgaggcgctcagggtgccctttcccactcctggtctccttccttgcaaaggataatgtctacccttgtgttaactagcccatgtatggtgttctcatttgagctagatattctacctaagaaatctaaacacatacattgtattggactaataaaaagttgtatgtaaattatatattgtgcatgaccagcaattggccttttcactcaatatgatgtttttgaaatttattcaagttgacacatgtatagtattagcagctgcatggtgttccattgtatatatatgtggttttttgtttgtttgtttgtttgtttgagatggaatcttgctctgtcgcccaggctggagtggagtggcgtgatctcggctcactgcatcctctgtctcccgggttcaagtgattctcctgcctcagcctcctgagtagctgggattacaggcacgcaccaccacaactggctaatttttgtatttttagcagagacggggtttcaccatgttgctcaggctggtctcgaactcctgacatcatgatctgcccgccttggcctcccaaagtgctgggattacaggcatgagccaccgcgcccagccatatgtggtttatttacttctcctatggatggacatttcggatttttccctcagttacctacagtgctgctgtgtgcattcttgcatatgtattcttttgcacctacatggaagttctctgatatattcagaggagagaggaggtaaactgtcaagtcataagttgtacatgtcttcaactttacaacttatcaccaaattgctctccaaagtggctgttccagttggacatgcccatcctgtttctcccttgccaatacttgtctttatcaaactttaaatatttgccaatcacatgggtgagaagtgctatctcattgttttaacgagcatctccctggttcctggtgagattgaccatctttgcaaatgccagttgtgtttccccttccatgacctaaatgttcacatcctttgcccatttttccatttgatgcatatgttgtccctactgatgtagggtatggattctatatatatacatacatatatatatatacacacacacacacacacacacacatatatatatacacacatacataaaaggatcttttgttggctatgtgcataacgtgtttctcctcccagtctgtggttggtcttttcacagtgtttaaagagtctttttaaacaaaagttttaacttcaataaagccaaatttacccccattcttctgtattgcttatgctttttgagtggtttatctaagaaatacaaactccatctgtaataaaaatacaaaaaaaaattagccaggcatggtggcacacgcctgtagtcccagttactcgggaggctgaggcaggagaatcgcttgaacctgggaggtggaggttgcagtgggccgagatcatgccactgcactctagcctgggcaacagagtgagactctgtcttgtaaaaataaaaaagaagaaaaagaaagaaaggaaaggaaaggaaaggaaaagaaagataccctttctatagccttctattttttatttttcccttttttgacttttgagacagggtctcactctgatgtccaggttggaatacagtggtgtgatcatggctcactgcagtctccagctcctcactcaagcaatcctcttgcctcggcctcttgtcctgttgagtagctaggactacaggcatgcaccatcatgcctggctaatttttatttatttatttattttttgtagagattgggtcttgctatgttacccaggctgatctcgaactcctggcctcaagcaatctttccaccttagcctcccaaagtgctgggattgtaggagtgagccactgtacctggcctccttttatatttttttctaaatatcattctatatgttcttctaaaagcccatttgttccattactctgaaagacaatccaagatacgtcagagtctcttcttgggaaatatggaatgacgtcttgcatattgtcatgatatgtagtgggtgggtaaaatccgtgaaagggtgagtattttgcttttaaagttctgtgactatgggatggcactctaagcttcagctgcagttgggaaagacttttgctgtagaccaattttattgtacttagtcgagttctagagggagccaggcccagaaaatgagggggacatttacgtcatggaacacagaggaagactcatgaaatggcaagagaccctcccctcccctgacttccaatgtgacacccgtcttctctgtcctctctcttcatactgttgtcttaggtgttccttgtaaccagacttcaaactatctgaaaacgtttgtgagaaggaacacacagacacgcacactcacacacacacacacacacacacacacacacacacagaactgctttggacttggatacttcctagtcctcctgttattcctatgaacgattccttctgttcttctaagtcccttctactttattcagagattatcatcatgactgctcatgatggcagtcagtttatccagatcacaagtcagaagggtgaaatcggctgaaaagaggatgaaatgttttaaacgctcaagaatttccagtcaccacagtcctgaggttcgttgtttcttttctgtctgaaagctgtagaactccatgcagggagcctgtgagcctcggtgggctgatgaaacactcagaagaaaaaagaacttgatggaggcagttgcctgtttagcagacgggatctgaatggaaggtctgagggtctgcagatgtcagagctgtccatggctttgcctggtgtctgtctgagcgatctggcctttgtccctgatgcctaatctgcctgtttgtctctctgagatagccaccaggtggtctactgatgatcaaagccctcgatggtgcagactgctgtcacccctcggctgagtcccaagatggggagtttgagaatgccgagtcttgctgttgccctttctgaatggggtgatgcctggtcagatttcagtttcctggaacatgtgttaatggttctcagcagagggtagggctttatttacacacctggctcagtctagactgcagacctttcaaaggtttgcagagcggccgggcgcagtggctcacgcctctaatctcagcactttgggaggccaaggtaggcagatcacctgaagtcagcagttcaagaccagcctggccaacatggtgaaaccccatctctacaaaaatacaacaacaaaaaaaattgctgggtgcggtggctcatgcctgtaaccccggcactttgggaggccgaggcgggtggatcacgaggtcaggagttcaataccaacctggccaagatggtgaaactgtctttactaaaaatacaaaaaagccgggcgtggtggcgggtgcctgcaatcccagctattcaggaggctgaggcagagaattgcttgaacccaagaggcggagattgcagtgagccgagatcacactactacagtccagcctgggtgacagagtaagactccgtctcaaaaaaaaaaaaaaaaattagccaggcatgatggcagatgcttgtagtcccagctactcaggaggctgaggcaggagaatcgcttgaacctgggaggcggagcttgccatgagccgagatcgtgccactgcactccagcctgggcgacagagcgagactccgtctcaaaaaagaaaaaaaaaaaaaaaaagaaaggtttgcagagtaactttgtgtggctttcttgatcaactgtgggtggacttaagatttacagccgaataaaggacttaaaaatacagccctggaatttttgcctcttcaaatgtccttcttgaaaagaacccctttcagaaagttccactttttaggtggagccccctgagccaacgctctgctcttcggaatcattgatctgtctggggatgagcaatgctgttgtcttcatcatcctcgtcttcagcagcatcaacagcaaggtgaatatttagctggtacacatacaggtggccacaccactcaccacctgttaaaatattgagacactgccacacgtgttggtcaagagctgctgctctgagtcccagtctccccaccacccaggccctgcctctgggatctctgggacctccccacaaatcagcaatgaaagcgttggcacctgaccccacagtgggtctccagggctctgctcagcactccagctggtttatattctggtaggaagacagacacccacacacccactcccatagtcattgaggaatccattctgattgatgcccatgccacagagttgttaaatatcgtgaatttcaagtcatcctaagacaaaaatctgggctcttttctttggttagaagacaaaggaattccagcgtatgcagagctgtgtactgggttctttggagacattataatatatatagatgggccctgaaaggcttgcttgtaagggcagaacacacacacacacacacacacacacagacacacacacacagacacagacacacacagacacagacacacacagatacagacacacacacacacacagacacagacacacacacacacaaacttaaaaaagcaacatgtcaccacattgacactgatgtagattgtaagtgcagaggggccagagggtaaagatctagacagattgttcagagtgtaaatcacttagttttctgtgttcttaacagtgcctgccactgtggctgcttaggatttcttttctttttttaatatttaaaattttggctgggcatggtggctcgtgcctgtaatcccagcactttgggaggccaaggccggtggatcacttgaggtcaggagtttgagaccagcctgaccaacatagtgaaatctcatctctactaaaaaaaaaaaaaaaaaaaattagctgggcgtggtggtgctcacctataatcccagctactcgggaggctgaggcaggagaatcgcttgaacctgggcagggaaggtggcaatcagccgagatcctgccaatgtaccccagcctgggcgacagagcgagactgcatcttaaaaaaaataaaaataaaatttgagatgcttggaggaatagaaaattggtgaatgtttgaggcaggacgtgctaacgaagagaagaggctgacattctgcccgagaagcagggcacgatggcgtggcagccctgggctgtcgctggagcgagcttgtttatggaagtaagaggaagtgggcccgagggatgcagagcagacttgcagggtcctgaaggctggaaactagattttgggtgtattaggaaaatcatgaagacatgttgaagaactatcagccatctcttaaactagaaggcaggccttgccccagaacaattaagtcatctgtttggagaagagggaacagagaggagcctcgtggcctcaaccactattttatcgtgacattctgcagaaatcctggccattttttcttttgctctctgtacctttctgaacttctctgcagggaagtgttgcagcagatgccctcagctcaccagagcccgtgttagccctggttccggtcctcagtctcactgggtgataagggaagatgagggaaaactacttctatcagtcacagcaccaacagtgccaacacggccgtgcacatccaaatggcttcattatgctcaacagcctgggtgagtctgagccttacagctaagatgcattgctttttttttttccctcggtgtgataaaaatgctggtagtatacttttataccccaaaataactgagcacattgagaaagacacggcgacctacttgggaacttcagcagtattagctggaacgctgtctggacagtggaaggactttttgcagggagctgccgtcagaggactgagagccagcgttcagcacggcatcactgagggcgcctggcatgcctccgcctgcccgtgagaaggcacgcttaccttctagatttctcacactcctccagagttgcattctgcttccgtaactgtcctagaacagcatttcctgtatgaagatacacaggtttggccagagactgaactctggttacttcctgaacttgggaacaatcctcaccaaatccactaactattaatcatggtcacagacactctcttgcttttgcatgctctgctgtgatgaagattgttgacgccaagaactaaatcgtaatgagcccacgtgctcttcacagcaggctccgataacactttgtcgcttttatggttaaacctcctcgtaaaatctctctttaagcgaacacgtgattatccccacggtagtttaaactgaacttgatttgtgagtttatttcttcttttccatctgagatgtttgccaatatctctgacatatattctcctatggaaatagccagaaaatgatggatcgaggaaatcaagtgtaaatcagtctgtacctccgagtggaaaccagtcagtgggatgtgaatatacttaatatgttctgttgtcttgtgtattgaaggagccttcatggagattttatatctctggagaaactcctgcaggttgcctttttagagagaggtttgaaataagaacaaagaaagtgagttcgctttagctgagtaaggcagggggcaagtgaagcagtgttagaggaggtaatgtggcagctgtctataacaggtggagcaaggtgatttttgtgtgtttgtttgtttttggtttatttttgagatggagtcttgctctttcgcccaggctggagagcagtggcatgatctcggctcactgcaacctctacctcccaggttcaagcgcctcctgagtagctgggattacaggtgtgtgccaccatgcctggctaattttttgtatattttttagaagagacagggtttcactgtgttagctgggatggtctcgatcttctgaccttgtgatccgcccgccttggcttcccaaagtgctgggattacaagtgtgaggcaccgcgcccagccacaagatgagttttaatggccaaacagaattcctgtttcacaacaattgacattgtgtcggctcccttgtttgtgcatatgtgttaatctattttttttttttttttttttttgagtctcaccttgtcgcctaggccggagtgcaatggcatgatcttggctcactgcaacctccacttcccgggttaattatcctgcctcagcctccctagtagctgggactacaggtgcccaccaccacgcctggctaacttttgtatttttagtagagatggggtttcaccatggtggccaggctggtctggaactcctgagctcaagtgatctaccttcctaggcctcccagagtgttgggattacaggcgtgagccactgcatcaaaatgcaatttattttggatactgaatgcacagaactgatctgggaagcattgctttgttttggagtttgtccaggacaggttagaataatattaacatttgatctgaaggcaaccttacctagattatctataaattgttataccacgagacagaagaaatcctattttcccacttaatatctgtgttaaaaattatcctccaaatatctatcaaattttaaaaattatgaaacatattaaaaaatttaaatctataggaaataatataacatgatccgtgtagctttcatgcatatttagcatgttgacatactttcttcagatgtgttttttaatagaaacattattgtcgaaggcttcttatttccctcttctttccatcctgttgcactttctttttccttagagataaccaaaattagcctcctacatacttttatgggtacctacatctctttgtaggtaggcgtattatatatagtaaagtacaataccgtatattttgtatgctttaaaattatttaatatggtaagatgctccacatatcagttgagaacttgacagtttcaagatttatctatccatttggtttatttgaactgtggtataactttctgatgaatgactgtaccttgatttacttagcttttcttcctgtgatggacactgttacaagcggtgctataataaacttgtgcaagtaactcttcatacctgtcttggtcatgtaatgtgctggctcacaggacacatacatagtcttcagcttaactagatgttgccagtttgttctccaaaatggcttctctgcaaatctcactaccattccatattttcagattctaaaatcctgccatcctcagatgaggataaaacgatgttttcttgttttgagatggaacatcttttcatagttttattgaccatgggagttttctcttttaagaattgcctattcattttctttgcccgtgttttttctcattgtattgtcttatttgtgtccattattgtaattgaattttaggatatttgaatgtaaatcttttgttatcgtattgggggttcccaagaccacttctaggctcagtaactcactaggttgctcaagaggctcagcctatagtcctactcacagcaaagacttattacagtaaaaagatataaagcaaaattagccaggggaaaaggcacagagggtggagtccagaggaaaccacgtgcaagcttccaagagtcttctccagtcacataggacacacttcgtttccccagcatcacattatgacaacaggtgtgaagtgtgtctaccaggaaagctcattagagacttagggaccaaggtttttgttgggggctggttatataggcaacctctctgccttgcctgtacccaaattccagattctcagaaggtaagcaggtgtttagcataaaccacactatttgtacaaatatttaggcacagtgagtcactcttaccagttctaggaatggtaggaaccctcctgaaatcttaagttctcagatgccagccaagagtcaaccttgcaggcaggtcttctaactttctaattttaacttttctctgcacggttatgttcatttcaaatatcttctcctaatctgtgtttatattgtcttttgctcatccagcagtaatatctgtctttttcaacgctttataattttaatatcatgcaaaaaaatccttgcctaccccattcataaaggtagctccttatatctttctctaataattttaacacattcctttttgtatttaagactgtaacctaactggaggttatttttgtgactggtaaaagatatgaatctcatttatcatttttggcatagaagtagccagttgtttctgcactgtttattgaatggtctatcatatcctcatggatttgtgatgcttcctctggcataccaagttctcctgtttgtgttatctatctctgaactaaattccacaccatttaattgagtttataaatcttaatatttaatagcataaattgtcccctgccttgtcttattgattcttggctcttatgactggcttgtcaagttctgccaaaaatatatatatatggttaatatatattaagattaatgtatatgaatttttctgtcagaattgcttggaatttttagattaatgtaaggataatttacatctttacaaatatctggtcttggcttggcctggtggctcatgcctataatcccagcactttgggaggcagatcacttgagcccaggagtttgagaccagtctgggcaacgtggtaaaaacccgtctctgctaaaaatactactaaaaatacaaaaaattagctggatgtggtggtgcgcatctgtagtcccagctactagggaggctgaggtgggagaatcacctgagcccaggagtttgaggctgcaatgagtcaagattgcacctctgtactccagcctgggcaacaggagtgagaccttgtctcaaaaaaaaaaaaaaaaagaaaaaagaaaattggttttcccatatatgaacatattatatagctcttcattcatgtatgttttctttattacctttcggtaaatgtttatattctccataaagacattaacatgttttgttggaattcttcttaggtactttagggttattatttgttactgtgaatggattgttctttttaaaacttacattttctaattgattgattgctgttgacctgtatgggtttttactattaatgagatatataacaaactgaactcttttattaagtctaataccttgtggatcctcttgaatattccatgtagattatcatgtctgcaattatgactcttttgtcataattgcagataatatgtctgcaattatgactcttttgtcataattgcagataatatgtctctttctttttaatcctaattcctcttattgacttttcttgtcatattcttctagctagggtctctagaaccatgttgaatagaagtaatgatggtgggaatccttgtcagttctaagttttgtaagggactgcttctatcacttagccattaagtatgatgttcactgtgtgatatgggtacacatgctttatcaaggtcaggaaatttttgtcccagtttgctaatattttttaaatttcataaatcagaattgaattttatgaaatgttttctctacatccattgaggtgataatttttttcttaattttttttttttttttttgagacggagtcttgctgtgtcgctcaggctggagtgcagtgacatgatctcggctcactgcaacttccacctcccaggttcaagcagttctcctgtctcagcctcccgagtagctgggactacaggcgcccaccaccaagcccagctaattttgtatttttagtagagatggggtttcaccatattggtcgggctggtctcaaactcctgacctcaggtgatctgcccgccttggcctcccaaagtgctgggattacaggtgtgagctactgggccctgcctcttaatatgttaatgtaggagttacattaagagatttttttagtgttaaatgatttttatattatttgcatcaaagatgctttggtcattattattattttaaaatatattgctggatttgacttgctaacatttcatttggaagtttcacatctgtttgctagtgaatgtggcttataattttcttttcttgcactcccttcatttagtttggtttcagagtgatactagctttaggaaataagttggggtatgtttcctctttttctactctctgaagagtttacgtaagattggattaatacagtttggtaggatttgtctctaaaggcatttggacatggggattattcatgtgtcaattttgaactactaacttaattttttaaaatggttataggacttttcagtttttatatttattcttaaattatatatagattaaaaaattttgttttaaattttcctgtctatagactttgaagtcctgctttttttttttttttttttttttttttgaaacagagtctcgctctgctgcgcaggctggagtgcagtggcgcgatccctgctcactgccagctccacctcccgggttcacgccattctcctgcctcagcctcccgagtagctgggactacaggcgcccgccaccacgcccggctgatttttttgtatttttagtagagatggggtttcaccgtgttagccaggatggtctcgatctcctgacctcgtaatttgcccgcctcggcctcccaaagtgctgggattacaggcgtgagccactgcacccagctgaagtgctgttttttttctttaacattatgggcattttctagatcattcaatatttactgagaagatgacctgtaacgcattgactttagcagtagtttttctttctgattaactttatttctagaattttattaggttgcatatgtcccatggatagggtggcataagtggccgtgctgggcacatggtagacatatagtaatttctgctggatatcgtacccagaactactcaggcgttgtaactttccagagcaaaaaattggaatttcctcatgttttacagggggagggtaaaggcgattctatgaaaattaacaaagggggttgggggaggagggctttcctttttgctaaaggaaaaataacacattcttttcgaatgatgacttatttttgaaaggcatcctggctgaaatgatgagctcaggttttgggtctgagcagttcctattgaaagatacttgtggagatttccaaaagtgcatataagaatggcaggttcttagttctgggggaagagtgactggggaggaaatacgtcttccccttttattgatctcagttacgtgctatgacatcacatgtaattttttgtggagctgttctgatgccccacatgaggcccgtgtcctttgctgccagtgcattccaagagggctgtaccctgggggctatgcaggcagctattcttgtgtgggcttttgccatgcctgtttcaggtttggaactgtatacctttcaggagcatggcttatgacatagcaattccattttcttaacaaaaacgaaccctatttttactttaaaagtaaacattccctctgctgtggtttgaatgtgtccctgaaagttcacatgttggaaacttcatcctccgtaacagtgttaagaggtgagacctttaagaggtgattaggtggtgaggactcgccctcatgaatggattaatgtcattatcttgggaattatcttgggtttctgataaaaagatgaggttagcctccttctcttgctctctcttgttcatgtgatgccctccaccatgttatgacccagcaagaagaccctcaccagatgttggcttcttgatcctggacttcctagtttccagaactgcaaagaaatgagtttttgctctttataaattacccagtccaaggtattgtgttatagcagcgcaacatgggccaacacaccctctatccatctctccaccggccaaaatcaactaagtgtccagcttcattacagccagtgtcctttggaggagaagtctctgaacattcctgttgagattcctgattggagctgtgtgaaacccatttagattgaaatcagaaacatggtcaggttgtgagttttccttttggagagccctcccttattttcacatgctcattctcaaaagcactttgtacatcatgtgatttgtatgttttttgcttggtacgattacacagccctttacaacccactgcccacacatgagctgacccagtggcttcgtgctgtaaaggcagatccagaaggcagtgctgccaggctctcttacaaaaatcagtttgtcttcttttgagatattcctgttctgagagttaaaacaaactcttgaaggcagcagtatattatagatgcaaaatctcacataaaaaccatttaagaaaatctggggacatggaaattgtttttttccctttaacaagatggtaccactaatgtattcttatttttttgcccagagagtagcaatttctaaattgttagacatggttcttctttggtttcacataacccattccttcatggtacttaaagttagtaaatggttgaaatacttccttgagaagtagaaatgaggaagcatgaagagattaaatgagtcacttaaagccactgtaaggaagttttccttcctttttattggtttctgcctttggtgttctgctgcttaccctccctccttcctacctgccttgtgctggaaagggccgggatttgggtatgcccttctcagctgtgtgacttcgaacaagctatttgacgtctcaaggtcttacatttctcatctgtaaaatctaagatccttctcttcaaatggctcccaggtcacccctgctgcagaccaggaatatggctaacattttgggatttgacatcaaatcctgagttgactttacgtaacctgggtccatgacatgtactagctgcaaacaagaagctgatgtgcacattgtctcaggacacctggaagcaaaatgttgaatgttagatttagaagggaccttcatcttccctgagtccaacagccccatcgtccggatgaggaagctgaggccaaggttagcccttgagggctgcagtgctgaggtcctgtgtccttgcccctggccagtgctgctcagccttccccacttttaggagagttggttgactttttgtaagacccaggtgggtataaaccaacaataacattctgagctccccaaccaactgaatggacctctcctctccgcgaagggcattctaaagtcagcctgaaatgctaatccaggcggtgatgggaatgggctgtgggacgtgcctccattacagcctcctccccttggaattcaggcacagctgaccagcattcacattaaaatagagacttcagactgacaaagcggactctttgtagcaatgagataccaacttgacagatagccggccccaaaagaaataaaagtattttgcctcaaaatatatttctttgatgtattttgaaatgtccctgcaaagctgtctcttgtggggaaaatctacattctgtggagaatctccttcccttcccaggtctttttcctgatccagtagagaattaactaagaatctggcactttttgaagtctgataagaaacatttaccatctattctctccaaagcctgctacctggaggcttcatctgcataataagaaccttggtttccataaccccttatcttaacccagacactcccttctattgattccaggtctttagataaactcaaccaattgccaatcagaaagtgtttgaatccacctgtgaccaggaaccccctcagcaatcctctgagttgtcctgcctttcaggaccaaagcaatgtacatcttacatgtattgattgacctcttgtgtttccctacaatgtatacaaccaagctatagcccgaccacttgggcacgcattctcaggatctcctggggctgtgtcacaggccacggtcactcatatttggctcagaataagtctcttcaaacattttacagagtttgactccttttgtttacatgggattgacagatgatatcccctgcctcgagggaatacgtgtgtgggcatctgaaatgtcatctcagctcacctctcaatgagtgggaagagactggaacacttttctccatggtccttgaatttttgtcgttaaacgagttactcttcagggcccgtcgtgtgaaaagctttgctgcacatcagcctggaggaaggctggacaggagaaatagcttcccaccaaagccctcccgtgtctagaagcatcacagtggcccttgcttaggtggcagaggacaggggtagatatttgtgatcaagaaagttggtcaggccgggtgcagtggctcatacccgtaatcccagcactttgggaggccaacgtggacgaatcacttgaggccaggagatcaagaccagcttggccaacatggtgaaaccccatctttactaaaaatacaaaaagtagctgggcatggtggcacatgcctgtaatcccagctactcgggaggctgaggctggagaattgcttgaaccgggaaggcggaggttgcagtgagctgagatcatgccactgcactccagcctggtgacagagtgagactctgtcttaaaaaaaaaaaatgttgctcagaagcttctcgatcttgtcacattctccggtggtgagttgagagcagcccaggcctggggtcctagggagcttgacgtggctactgttctagacagtgctgagtttgtcatcaccttgctttcattatgatttcctcctcctcgtcaccacctacggtgtttatggagttcgctgtacatgaagccccagcgtccagaggtgtaagacagagccccttctaggagctgctgtccatcccactgaaaggcaggtctgacacagaagagacaaacaaccatactgggcctctggggccccgtgagatgtgaacttcaggtaccagagtgcatgcgggaggaggcctgggtgccctggggacccaaagcaggagctcatttctgacctgcctctctcaccaagcttcctttgctgaatgccgtgggcaaacagtggtgttggtattggagcaggatcaaagctcattcctggctaacctgcaaaaatgagcaggtaaacaaatgggatccataaaatagagactaaaatgaaagtttgtcttactgtgattagcaactggcccctttccaaattccacctgctctgcgtggagctgtggcgtctcattccaagagccttctcacagcatctgacccgggcctggggtaacagtacactggggtttgccaaggataaccatagcaaggcagctacaggagcacagcatggtgggggggcatgaaatcagaacaagcaggacccacgggcgggggtgagagcaagtggctgggaggcagaggcagaagtgatggctgctgactcaccgtgtgtctgccaggttgcttaacccatctccgctccggttttcccatgcgtgagccctctgcagtgtgtggcatgctgatcggcctctggcatgaagagtaaaagcaaggccacataaaaatcacaggtgcccctcgcttcgtgcaacatgtgtgccagtccagtttctgcaacagccccccaggcgctgagcctgctccatgggttgggagatgttagacctcaagctgtgcccctagctgggtgggtatgggaagttacatggcagtgctggctgcattctgcttatcactgaaagaagtggctttggaatgggtgatttcttaaggtgtttccccactcagttcttctgttcatttttgtacattattatctcttcattgttgtacatttgttggagcttagccccaacagtgcctgcctaggtggtgcggactgaggaatagagatggagtaatcatgatatccaatgtcttatctcactggcctccccgccccaccacatcccttcccattggacggtgaggactgaggctccatcgctgaaatgcacacgtgttaccaggcagggttgtgagggccagttcaatgaacataaatacccttgtcagatcagttgtcatgattctagagaataaggccggaggaagtgagcatgctgatactaaagaacaggggagagaatactgggtttggttgtgcctggtcactaaaagcaaacttcacccactgagaacctgctagtcaacctcctatgatgttcagaagcctcttgaatgttgataattaatggacagggtgagcttggccaggcaggctggctcatgcctgcagtcccagcactttgggaggtcaaggtgggcagatcgcttgagctcaggagttcaagaccaggctgggccacatggcaaaatgctgtctctggaaaaaatacaaaaaaaattagccagatatggtggcatgcacctgtagtcccagctccttgggagggtgaggcagcaggattgcttaggcccaggaggtcaaggctgcagtgagacaagattgcactgctgcaccccagcatgagtgacagagcgaggtcctgtctcaaaaaaaaaaaaaaaaaaaaaaaggtgagcttttctctactgagtttcttgaagtgtggcacaactgaggcatagcatagtgggacaggatgctgttcatttatctgagaggtgaaaggatgtacctcctgctgcttttttggtgggatggggtcggaggagagcctgatgagccaggcaaggagaggaggtaacagaacactggtggagttgatggtgagaagctggactctctcagtgggctgtttgcctgcccctcccttcatttcccataggcttcggtagaagcgtggcctgcagaatcaggaaacagtgctggttaatctgtaagtatgcaacattcttgggcctttctgtcactgaagagcataatgtaattcaggccagtgcagtactgagatatggagtgtggccagcacccatggcaggtgcttggaggtttatcctagtctttctgctaacttcctggcccaagtgcaggtcacttaccttttctgggattcaggtacctgtaagaagagaagtgagtgtgttggactccctctagggaactggaaggaataagcaataagtatactttgacattttataaatagaacatgtttaatacatgcatttcaacgaggcctataggattaacaactttggaggcatgtgtaccggtttgcggtcagtgctcacaccacctggtggaatttccttcctttgactggcaggaagagggaagtacttctcacacatctgttaccttctgccaagtgtaaatgtcatgctggcatctgtgtcttaattgtattggcattcccttgtactgggcctggatggggtgggtgctcaacccacacagacagaaccaagctcccgactgcagacacacatcattaagtttctggacttcagccacagtatctttgttattagattattaactcaatagccttcttgtcttttagcctaggactctggacatagctctctgtagatgcttattgatgactgattggctaacagatgcaatcacagagtcacagatgtcaactcttgcctgtccttccttcctttccttcccttccttccctccttccttcctctctgtctttctttcttttctttctctctctctctctccttccttccttccctccctctctccctgcttccttccttccttccttcctccgttccttccttccttcctctttctctctttctttctttcttttcttttttgatggagtttcactcttgttgcccaggctggagtgcaatggtgcaatctcggctcaccgcaacctccgtctctcaggttcaagcagttctcctgcctcagcctcccgagtagctgggattacaggcctggctaattttgtatttttagtagagacagggtttctccatgttggtcaggctggtctcgaactcccgacctcaggtgatccgcccaccttggcctcccaaagtgctgggattagaggcatgagccaccgcgcccagcttgttcgcgctcgcttgcttgcttgctttttctttctttctctctctctctctctctctctctctctctctctccctccctccctccctccctctctctccctctctccccctctctccctccctccgtctgtccctctctttctctcgttctctcttttctttctttctctcaagacagggtctagctgtgttgcccaggctggaatgcaatggcgtgatcatagcttactgcagcctctgcctcctgggctcaagtgatcctcccacctcagcctctctatagctaggactacaggcatgcgccaccatgcctggctagtttttgtattttttgtagcgacagggttttgccatgtgcccaggctggcctcagattcctgggctcaagcaatctacccaccttggcctctcaaagtactggggttatagacgtgcgccaccatgcccggctcaacccttgtatttcttgatggttttcacatgcagaagcccaaaatctgggagataccgatggcccctggatccaacactagagttatttctctccacagcagtttgcctcatgctcctttggtcactgataagtgttgttaacatttttcaaatatcctgtctgcactgaggtgtgacgagcacattattacctctgattcccatgctgacacacagatcgggcatgtctttgtgtttgtctttggagagccttatttttctcatgtgatatatacaccgaaatacacaggaatcattattgtacagaacataggagacagccactatgaaagcaactgtccggctgatggaagaaaagttcaggggcttctcattttgattacctgtgattttgctttgcatacaattttatttccttggtgagagctgcttcttccttgctgacttttaagagacattggaagacatggggcgggtcttctgaacatctacctgtgcgtcactttttaatttcttttccaggtagagtctgcagtgagggaatgagttctttttttgtttatttgtttgttttttatttttttttgagatggagtttcgctattgttgctctggctggagtgcaatggcgcgatcttggctcactgcaacccacaccttctggggttcaagcgattctcctgcctcaggctcccgaatagctgggattacaggcatgcacctccacgcctggctaacttttgtattttcaggagggacgtggtttctccatgttggccaggctggtctcaaactcccgacttcaagtgatcctcccacctcggcctcccaaagtgctgggattacaggcgtgagccactgcgcctggccaggaatgagttcttaatgagagactcttgagtctttctctggaagtagaatggaatttttagaaggatgaaagacagatgttcatttcacagagcaggctgctctattcacatgcagcctcaacaccagtgacattccaaccagtgtttagggtttagttagggagagaacttcatccccattagttcatatgtgtgtatgttaaagcacttagaaccatacctggcacataagaaaaattctgtaagtattcattgttcttgttattaccatcatccttgtaattcagtgattcatggcggggtgcagtcaaggagtgtcatgacaagcgaacttcagaagactgcatcagacttacaggtcactgcttttgtagccccagtacggtaggagaaacatccactgggaggtgggtccctcgttagccctgaagagtggattgctgatgccttctgcttcaccctctgcttgtgctccttcttccaagctgttaatttctctgaaatcttgtgtttctttacgcaggggttcacatcctgattgcttgttccactcggaagggaaggcagagggcttgcatctgaagccatgcctccttcatcagtgctgtatcgagctctaggtttgggttcttggcacttcggtgcttcccttctcactcagtagtcataatgttagcacggttgatgcattgacacgctctagtgagcagtttgcaggcatctatcatgaactgttcaaagagatacgcagatacatctcacaaacactgatggaatacttagtatgtgctaggagggcactagggagagaaagatgaaaggcagcgcctgctgttgatttcatttgcatcttgccctcaggactcaggttaattggtctaggagcttatagactattaggcttcctagaccccttgggagacatgggacttgccagacccatttccccaaaaaaggtaagcactgtggaggattcttctcctagagtctagcatccatcatttcaccagtgtggctgattccaaaaaatgcattttgacaagaagagaaacacagttagttaacagacgtcagaatgtgaaataactttggctgattggaggagttaaccggttcttttgtcatcttgtggtccgttctgtgtgtgtctgcttagctttctcacgctgagccttttccctcaggatcttcagcagttttttccagtatgtagatgattcaactcacagatggcagcttctaagttattatgccactgattaaagaattgttaaggcagacttatttctctaaatacaaacacatgcaaaactgagattttgaccaaaactttgctagacacaatagtgtattgtttctctcttcaaagtgtgttccatgatagacttgtgttttataaaacagcagtgcttggcatgtatattacgaggtctatcaccaaagaattctaagctctttttaaaaagacatttttaaggtaaatgaccatttaaaaaagatactccgtctcttctatttttttcctttcttatatcttcagcaacatcctaaatgtgacaatgtacgtaaaacactactgcatagagtgaatgttcactaatgctgatgactgtctttattggtatctctaatagttggatttgtggttaaacatatatgcttcttgccccaaatgactacatctttgttttctgttcgggcaaacagagaactggagttcactgtgatctcttcactgttaacactatttaagtgttattcaaagaaaatggaaacttttggtctcagtgtcatgccaacttgttctagattattgttcttaaaaaaaaaacaaaacaaaaaaaaacagagccccaggctggatgccgtggctcacgcctgtaatcccagcactttgggaggctgagacaggcagatcacaaggtcaggagatcgagaccgtcctggctaacaaggtgaaaccccgtttctactaaaaatacaaaaaatagccaggtgtggtggcgggctcctgtagtcccagctactctagaggctgacgtaggagaatggtgtgaacccaggaggcagagtttgcagagagccgagatcgagcgactgcactccagcctgggggacagagcgagactccgtctcaaaaaaaacaaaaaaaaagagccctggccaggcacggtggctcacgcctgtaatcccagcactttgggaggccgaggcgggcagatcacaaggtcaggagatcgagaccatcctggctaacacggtgaaaccccgtctctactaaaaatacaaaaaaaaattagccaggcgtggtggctggcgcctgtagtcccaggtactcgggaggctgaggcaggagaatggtgtgaacccgggaggcggagctggcagtgagtggagatcttgccactgcattccagtctgggtgacacagtgagactccatctcaaaaaaaaaaaaaaaaaaaaaagttgagaaatacggagagacttattatgaagcaataaatagttatgacacgatgttattaacactgggagaaacaaatagaccgatggaacaaaatagatagctagaaatagacttctacgtaaggaaacttggttatgcagataaacattgtggacaagtgggagaaggaaggattattcaataaatagtgctgagacaacttaaaaatcatattttcaagaggttgcaatgaaggtcctcacatatcctatatacaaaaaattagtttgaagtagaccaaatacatcaatgtgaaaagcaaattctaaacagtttagggaagaatataggaagatattttcatgagtggtgtagagaatgactttttttttttttttttaaagacagggtctcactctgtcacccaggctggagtgtagtggcgtgatcagcgctcactgcagccgtgacctcccaggctcaaatcgtcctcccaagtgatcctcccacctcagctaggactgagactagctggggctgcaggcacacaccaccacacctggctgatttcttttgtattttatacagagatggggttttgccatgttgctcaagctggtttcgaactcctgagctcaagccgtctgcctgccttagtctcccaaagtgctaggattacaggcatgagccaccctgcccgacccaagaatgactttttaaagcataagcaaaaagcataaaccatgaattaatgattgctaaatttgactgtattaaacaaagaatatcagtttatcaaaagacaccataaagtaaaagagatccacaaacttagagaagttatttgcaatatatataactgaaaaaggatttgtatttagagtatgtaaagaactattaaataagaaaaagatactcaaaagaaaatgggcaaaggacttgaacagggattttagagaaaataggaatagttaataaacctatgaaaaggtacctaatcatcagaatttaggaaccccaaattaaagccataatgatataccatttgataccaaccagactggtgaaaatatgagtctgataatattaagtgctgacaagggatattggtcagtggaaattctcatacacagctggcaggactgtaatttggcacaacttttgaaagcaatttattcttacctctattaccacacagttctgccattccactcccaggaacagaccctggtggaaagagaataagctttggagtcagtccaggatttgaatccatcttttaccattttcttttctttctttctttctttctttttttttttgagatggagtctcattctgtcacccacgcggagtgcagtggcgcaatcttggctcactgcaacctccgcttcccgggttcaagcaattccctgcttcagcctcccgattagctgggactacaggcgcctaccaccacgcccggctaatttttgtatttttagtagggacggggtttcaccatcttggtcagcctggtcttgaactcctgaccttgtgatccacctgccttggcctcccaaagtgctgggattacagatgtgagccactgtgcctggcctgttttaccattttctaattgtgtgcccctgagcctatgactttctcagttcccttatctgtacagtgagagaatgttgtgtttagtaactgaaaattcatggcatatagtaaacctcactaaatgcagacacttttattaacatgtgactgaagggcaggccccctgtgggcctggtcttatccttatcctttttagtatatgcacttcttctccacagtgcatatgctaatactaggtattcaagaaagcaaggtttgatttggatttgcagtgtctcccctaaatgctcagctcctgctatatgcatttcattctgcacaaacctcctcgccgcctgccacatctaagctatgatacaaatattcttcacgtgtgaaattccttgctcactgcttttacctcactgtggccatcttctctactaagaaagtcagctgtggtatcaacacacaagaatgtgtgcagctggtagtgtatacattcagaataacaaaggttattacactgaaaggatgtgttttttctttattactgggcatcttaattgcttcttggatgttacaagcccagcattgcgaagtacaccgtagagcagaggactaatctgtggattgagttgaggcacaaccctgtgagtgccctttctcagtgcagcagtctcagaggtaattttactcttttctgaaatctcatttcttattttggtgtgtgcagaaaagctcaactggagttacctgcaaatgcaggcatatgtgatagctctgctcagccacgtattaagccacaagcagccaagaacagatactactggcgacagctaagtaatgcacacacacacacacacacacacacacacacacacacacacacacacacaaaaggagaaaagtgataaagaagcaagaattccaagtgagttacaaactccaaggacttggaacatattctgaggaattcttaaattgaggcttacgagtgagaatatataatgtgtctccttaaacgttttggggtgacagatatttctgggttgtgggtgatatttttagggagctttaaagaatgaattcaggagacttgcagcctgatgctggttgtctgggtattttgggacatttcttatagcccagctttttattgctcaacacagatttagaagcttgtcctaatcaccaggaagatccttaaagactggcaataaagacaggaatttcaggagccaggcacagtgcctcatgcctataatcctagcacttcgggacatgggggtggaaggatcacgtgaacccaggaggttgaggctgcagtgagccatgattgcaccactgcactctaggctgggtgacacagcaggaccccgtctgtaaagaaataataacaggcctggcgcggtggctcatgcctgtaatcccagcactttgggaagccgggccaggtggatcacaaggtcaggagatcgagaccatcctggctaacacagtgaaaccccatctctactaaaaaatacaaaaaaaattagccaggcatggtggcacacgcctgtagtcccagctactcaggaggctgaggcagaattacttgaacccagggggcagatgttgcagtgagccgagatcacaccactggactccagcctgggtgatggagcgagactccatctccaaataataataataataataataataataataataataataataataaagttttttttttaaaaattgggattttagaccaatgtgagggaagttagcagcatggccctgagaagccatgtttccagagtgcactgttaggactgctgaaacagtttaagtacagacatacaagtcagcacacaggaagcagagcccgggaggattagacctgacatttgaaccagtccgagcccctctgtctaggtatctcctccaatcctccagtcatccctggttaaatattttgatttcttttgttaatactgtataataattctaaatctttctgagccaacattaaggtgaccaaacatcctggtttgcatgggacacaggactttcagtgctaaaactgggacagttctgagcaaactgggatgcttggtcctagcggacaactgctttgtgtgtctggtacaggtgagccacagctgtgtatacatgtgtagtgggttgaatagggacccaccaaaaaaggtgtgtccacctagaatctcagaatgtgatctgatttggaataaaggtcttttttataacaatgacaacaacaaaatctaccctttcaactaattttaaagtgtacaatacaatattgttaattatatggacactgttgtacaatagatctctagaaatttttcatcttccataaccaaaatgctgctcccaccgaacggctcctctccccctcctcctcccacccaacggcccctctccccctcctcctcccaccgaacggcccctctccccctcctcctcccacccaacggcccctctccccctcctccctgctctgtggctgccaccattctactttctgctgctttgattttgactacattagctacctcatctaaatagaatcacacagtatttgtattctgggactggcttatttcacttagtataatggcctcaaggttcattcatattgtagtgacaggatttcctttttttgttttttgtttttttgagacggaggttagctctgtcgcccaggctggagtgcagtggtgtgatcttggctcactacaacctccacctcctgggttcaagtgattctcctgcttcagcctcccgagtagctggaattataggcgcctgccaccacgccaagctaatttttgtatttttagtagagatggggtttcactgtgttggccaggctgatctcgaactcctgatctagtgatccatccaccttggcctcccaaagtgctgggattacaagcgtgagccaccgcacctgcccccaccccctgccacctttttttttaaaggctgaataatattccgttgtctgtatagaccacattttctttatccactcatccatcagtggatgttcaggttgttcccactgttttgctatcgtgaacagtgatgcagcgaacatgggaatgcaaatatttctttgagattctgttttcaattctattgaataaatacccagaggtggggttgctagatcacatggtagttctgtttttaattttctgaggaaactccattctgttttgcatagcagcagcattatatattctcatcaacagtgaacaaggatttcagtttctccacatcctaatcaacacttactttctgctgttcttttttcttcttccttctttccttcccttccttcttcctttctcttccctcccttcttcccttccattccttcttcttttcccttccctttcttcttcccttccttcttcctttccctttcctttcttcttcccttccttcttcctttcccttcctttccttctttccttcccttcccttccatcttcccttcccctccttcacttcctttttcctttcccttcccttcctccttcccttcccttccctttttctttcccttccttctttgtttccctttcctttttccttccctttccctttcctttcctttctttttgtgtttctataatcatggccatcctaacaggcatggggtgatacttcattgtggttttgatttgcatttctctgacatttgtgatattgagcatcttttcatatacctgcttgtcatttgtatgttttccttacagaaaggtctatttaggtcctttcctttatgtattttaaaaattggtttatttgcttttgctattgagttgtaggaattccttgtatattttagatatcaatctcttttcagatagatggtttgcatgtattttctcccactgcacaggttaccttttcactctgttgatgctttcctttgctattcagaaggtttttcgtttgatataatctcacttgtctatttttgcttttgttggcatatccaagaaatcattgccaagaccaatgttttgaaactttccccctatgttttcttctaggaggtttgtagtttcaggtctacatttaagtcctttaatccattttgagttgaggtttatgtatgcgtaagataaggatccaatgcttcttttgcatgtgggtatctagttttcctagcaccactttgtgagacaatcctttccccactgtgttgtcttggcacccttgctgaagatcatttctctgtgtatatgtgggtttacttctgatctctctattctgctccactggtctgtgtgtctgtctttatgccaatgtcatactgttttgattacagtagctttgtaagatgtttcgagatcagaaagtgtgaaaattctagctttgttcttttttcttcagattgttttggctattcagggtcctttgtggttggttccatgtgaattttaggactgtttttttctattcttcaaaaaatgccattgggaatttgctaggaatttcattaaatctatgactcacttcaggtactatggacattttaacaatattaagtcttgtaatccatgtacataggatgttgaattttcatatatggactttattatgttgactttttatatatggactttattaagtcttgtaatccatgtacataggatgttgacttttcatatatggactttattatgttgaggcaatttcctttttttcctggtttcttgcagttcttataatgaaaggatgttgaattcagtcaaatgctttttttttttttttacatattttgagatgatcatattatttttatctttcagtcttttaatgtgatgtaccacattgattgacttttgtatattgaaccatctttgcatctctgggataaatcccacttgaccataatatattatctttttaatgtccttttgattcagttttgtattttgttgaaaatttgtgtatctgtattcatcagggatattgggctgtatgtagttttcttttcttgtagtgtctttgactttgttatcactataatgctagcctcaaaaaacaagtttggaagtgttcccttctcttcattttttaaggagagtttgagaaggattggcattaattctttaaatatttggtagagttctccagtgaaaccaccttgtcttagacttttctttttgggagatttttggttactgattcaatcccatttctagtaaaagatctgttcagattttctgtttcatcatgattcagtcttggtagtttgtatatctctaggaatttatccatttcttctaggttatctaatttgttggtatataattgttcactgtggtcttttattaatactttttattctgtggcatcagttgtaatgccccctcttttatttctgattttatttatttggaccttttctccttttttcttagttagtctgcctaagagtttgtcaatttttgccaggtacagtggtgtgtgcctgtagttccagctatttgggatgctgaagcagaaggatcacttgagctcagaagttcaagaccagcctaggcaacatagcaagacccgcccccttcatctctttaaaaaacaaacaaacaaaaaacagatcattaattttgtttttcttttaaaaaaatcaagtcttggtttggttgtttcttttttctattgtttttatattttctatttcatttctttcaattataatctttattataatttccttccatctgctaactttggcttagtttgtttttttctttttctagtttcttcagttataaagttgggttgtttatttgagatctttattcttttttaacataggtgtttactactataaacttctctcctagtattgtttttgctacagctcacaggttttggtgtgttgtattttcatttttgtttgtctcaaggtattttctaaattccccagtgattgttttctttgactcagtggttaagagtgaattgtttcgttttcacatatttgtgaattttccaggttttcttctgctattgattttcagtttcattccattgtggttgaaaaaaatgtggtatgattttaaacttcttaaatctgttaagtcttgttttgtgccttaacatgtgacgtatcctggagaatgttctgtgtgtacttgaaacgaatgtgtattctgctgcttttgggtgaaatgttttataaatgtctgttgggtccctcgatctgtagtgttcttcaagtcctctgttttttttttattagccttttgtttggctgacatactgtactctatacattattgaaagtgggatattgagccaggcacagtggctaacacctgtaatcccagcactttgggaggccgaggtgggcggatcacttgaggtcaggagtttgagaccagcatgggcaacatggtgaaaccctgtctctacttaaaaaaaatacaaaaattagctggatgttgtggcacatgccagtcatctcagctacttgggaggctgaggccagagaatcgcttgaacccaggcagcagagtttgcagtgagccgagatagtgccatggcactcctgcctggggaacagagcgagacttatctcaaaaaaaaaaaaaaaaaaaaaaaaaccccaaaaaacaaaagtgggatattgaaatctcctactattgttgtgttgcttcctatttctcttttcaattctgtccatgttttatatctttgggtctctgatgttggctacatgcatatttataattgttgtatcttcctggtaaattcactcttttatcattaaataatgttgtttctggtttcttgtggcagtttttgtcttaaagtctattttgtgtgatataagtatggtcatccctgctgtcttttggttaccatttacgtagactacctctctttaccctttcattttcagcctatgtgtgtttttaaatccaaaatgagtcccttgtagacagcatatagctgaagcttgtttttaaaatccatttagctactgtatgtcttctgattgagggatttaattcacttacatgaaaagtcattactgataggcaaggacttactattgccattttgctcattgtttttatctaccttgtagctcttttgtccctctcactgtcttcctttttgtttccctcatttttcttctagcaatgttctttgattactttttcattttctgttgtgtatcgcctatagatattttctttgtggttaacatggggattacataaaacattttatagttatattaatctgttctaagctgacaacaacttcagtcacatacaaaatctatatgcttttctgcacactttgttattgatgtcacaaattcatgtttttatgttgtgtatccattaacatattttacataattattttttatacttttgtctttttttaattatactttaagttctgggatacatgtgcagaacctgcaggtttgtttcataggtatacacatgccatggtggtttgctgcacccatcgatccatcatctacattaggtatttatcctaatgctatccctcccctagccccccaccccacaacaggccccggtgtgtgatgttcccctccctgtgtccatatatcctcattattcaactcccacttatgagtgagaacatgcggtgtttggttttctgttcttgtgttagtttgctgagaatgatggtttccagcttcatccatgtccctgcaaaggacatgacatgaatgcacctttttttatggctgcatagtattccatggtgtatatgtgccacattttctttatccagtctatcattgttgggcatttgggttggttccaagtctttgctattgtgaacagtgccgcaataaacatatgtgtgcatgtgtctttatagtagaatgatttataatcctttgggtatatacccagtaaggggattgctgggtcagatgatatttctggttctagatccttgaggaatctttatagtagaatgatttatgatcctttgggtatatacccagtaaggggattgctgggtcagatgatatttctggttctagatccttgaggaattgccacactgtcttccaaaatggttgaactaatttacactcccaccaacagtgtaaaagcattcctatttcttcacatcctctccagcatctattgtttcctgactttttaatgatcgccattctaactggcgtgagatggtatctcattgtagttttggtttgcatttctctaatgacctgaccagtgatgatgagctttttttcatatgtttgttggccacataaatgtcttcttttgagaagtgtctgtttatatcctttgcccactttttgatggagttgtttttttcttcttgtaaatttgtttaaattcattgtagattctggatattagtcctttgtcagatagatacagtgcaaaaattgtctcccattctgtaggttgccttttcactctgatgatagtttcttttgctgtgcagaagctctttagtttaattcgatcccatttgtcaattttggcttttgatgccattgctttggtgttttagtcatgaagtccttgcccatgcctaggtcctgaatggtattgcctaggttttcttctagggattttatggttttaggtcttacgtttaagtctttaatccatcttgagataatttttgtataagatgtaaggaaggggtccagtttcaattttctgcatctggctagccagttttcccaacaccatttattaaatagggaatcctttccccattgcttgtttttgtcaggtttctcaaaagatcagatggttgtatacttttgtcttttaatctgtataccagaattaaaagtgatttaaacactactgttacagtattatagtattctgtatttgtctatatgtttacctttggtagtgaactttatacttttatatgctttcattttcctatctagcatcctttcatttcatcttgaaagactccctttagtaattcttgtaaagtcagtctagtagcaaggaactcctctgcttttggttatttgggaaagtctttattcttggaaagtatccttcgttgacaggtttttattctttcagcactttgaatgtattgtctcacttgcttcttgcatgcaaggtttatgctgtgaagtccactgatagccttttaggggttctattgtatgggaaaatttgcttctcttttgttgctttaaaaattctccctgggccaagcacggtggctcatgcctgtaatcccagcactctgggaggctgaggtgggtggatcacctgaggtcaggagttcaaggccagcctggccaacatgggaaaacctcgactctattaaaaaattagccaggtgtggtagcaggtgtctgtaatcccaactactcaggaggctgaggcaggagaatcacttgaactcgagaggcagaggttgcagtgagttgagattgcacccctgcactccagcctgggcaacagagacttccatcttaaaaaaaaaaaattctccctgaaaagctagaactttgaatacatgctccaactcttttcctccccagggagaagtaaggagttaggggttttctcctgtttattttgtgctgagctagagggcatggactatgacaaataagtacatgctgatctaaaccatttcctttattctcagcatcccttgacctggcgccctttcctattctaaaccatcccttgggcagtccccttgaaaagcctggacattggactatgatccagtctactcttccccgctcccgggagaagcgaggagctggcagtttcctcttgcttacactgtgctgacctgggggagggactatggtgaatggatgccatgaatttccctgccagctttgatcatctggttttgcagcagcctgagatgcaggagcctcttaactggtttccgtatttctcacaaagggaagtagtctatgtatttttgttgaattgctgtctctgtagggacaaagagggtcttgcagttcctattttgccatgttgccgaagtcacttcctggaatgaaggtctttacagatgtaattaaggtaaggatcttgagatgagatcttcttagattagggtggaacctgatttcaatgataagtgtcatgagagacagaaatggaggagacacaaacacagaggagaaggccatgcaaaggtagaggcagagactggaatactatgtttataggccaaggaatgccaaagattgttggccaccagcagacactaggagagaggtgtggaatggatcctctcttaggctctccagaaggaactcactttgctgacacctttgattttggacttttggcctctagaagtatgagagaatgaatttctgttactctaagccagcaggcttgtggtaatttgttacagcagccccagggacatgggaagtgagtttgggagttttactacaaaaatctaggaggaggattttagacctttattggtcaatagccttatctatgtcttcactctctgtgagcccacctgtatctacggctgttatccacataggtgttttgactagggatttctgttcagtgaggtccaaactgccttcctcagtgccctggggcttcctgaaggtgctcttggtgccccctgcaggtgccctgtgggctgctttgtggggagtgtgcgaggtgaaggctgagcctgtgtggctccagacccctggcctcattaaccaaaacaagttttagataagttatttttagggggattaatataggattttgtttgaaaacaaacaaacaaaaaccacttaaaaaaaaagtaaaagaaacgtcctaaaagctacaggttgcattcttgccttctttctcttctaacgtgattctttgtgcagccattttctgccaatgctcttcttgggtgcagcagtgtctgcagtcatggtgactgggaagtgggaagggggcttggagtagaactgcagggaggatgggggttggaagaacccctggtgcatcaggtaaaaccacaaggaggtatgctgccctcattcttatccctgaatatctattgtagcttcttgtcccctttcatggtcaacatcttgcaaataatttcgtcataggctggtatctcaatttcactgacggctcatggcaaagcatggagggaaaaaattaggaaggggtggggtgaagttattaaatactgggagtgagtaaaagtgggcaggcaggaaaattattctaaaagggttaggggaaagggaggtggcataataacaaaaggaagaactgtacctgcattagagtgctataattttccccaagtattgccatagaaatcgcacttcagactctacaccatgcatcaatttgaggagaacaatttacctgtattgtttcccatgtgtcatcagcgtcctctttctcctgtttcagtcagcaggactcatttcatccattttcatctggtactgttgactattcatttctttgcactgattttgctgccaaagtccccttttcaagtcatggacattattaagtataccctttattttacatcacttgccattttcagaactcctttatttcattactttgcattcagaatttccggcctaaatcgatagccttgacataaaggcaggtctctgctttctcttttgggcatgaacagttcctttcctgaatcagaaatttatttttctttctagaagtctagtgtggggaatagtcagcatgcttactaagtcttaatttgttagaaggaaagatgaagataaatattggtgatgggggttccctagaaaataaattctacctactcctaccctcacacgtttacactctgcttttgatgcatctcttgtattctgcttttcctctctaaagaagggaaacttcttcctgggaccagtacattgggctcattagttccagccccagctctgccacacgcttgctgtttagcttttagaaagttagctcatctttctgttttctggcctatgaaatggagactcactgatctcttggatggatgaagtaccaagtaaccactatgggacttgcccccatgcaggagtaatgaatgaatcaatttcaaaacagctggacactaagcccacagcccaggctctcctcagattcattctatttacagcccagctttcacacaacgtgtctgatagccagttccttacgaagcctctgtcatgcttacggagcacgtgaccctcttgaaggagatggggaaggatcatggaatgttaaccactgttcccatgcatggaactgtgctaagaaatgtgctcccaggtagttttggagccatatgtgtctgaaaagaactcataattagctgaagtcaagggaaggggtcttcttatcactccttctgtattgttttaggcactcacactcatcagcagacagagtgcattcactttcttttctttccttttttctttctttttttttttttttttagagaggaggtcttgctttgtcaccccaggctggagtgcagtggtgcaattatagctcactaatgccttaaattcctgggctcaagcaatcctccagcttcagtttgctgagtagctgggactacagacatgcactatcacacggggctaattttgtaaattttttgtagagatgcggttttgccatcttgcccaagctggtcttcaactcctgggctcaagtgatcctcccacctcagcctcccaaaatactgggattacaggcatgagtcaccgtgcccagactacatttactttcttgattgcactttgaggtttaggggctaatgcctgatgctttttttttatctgtatgaagcagcggccacacagatcttcatcaaaagctgactgttctcatttctccccaagtaatcactcttttttttttttagcttgtgctaaatcattttttaaaattgtagctctgaggcattttattatacaaagttagtactcatatacataaactaataggaacttaaaactcattatacctttgcttcattttttttagcttgactccctcgtaaatctttagcttcattgatttggctgctatgtaagcttcattgatttggctgcttaaatcactccgttgagtgatttaagagcataatttagaagaatggtgtgtccatgtgtggctcagtttacagtaccatttggagtttgattgcttctgtgagttgggtgatctctcctcttgaggtccagatcaaccccaggaggagcctagctgctgctccccattgggcgccccatttcagcagaagtagccaggagtcgtcacccagaaccccctaacagcagttagtgtggcatctccacagtggggaatgttgtaggagttattaagaaattattttggccgggtgcggtggctcacgcctgtaatcccagcactttgggaggccgagacgggtggatcatgaggtcaggagattgagaccatcctggctaacacggtgaaacccgtctctactaaaaatacaaaaaatacaaaaaaaaaaaaaaaattagcagggcatagtggcgggcgcctatactcccagttgctcgggaggctgaggcaggagaatggcgtgaacctgggagacagagcttgcagtaagccgagatcgcaccactgcactccagcctgggcaacagagcgagactctgtctcaaaaaaaaaaagaaaagaaattattttaggcagataaagaggaaaaggggtccttgggaagttttcgttttttttttttttttttttttatactttaagttttagggtacatgtgcacgttgtgcaggttagttacatatgtatacatgtgccatgctggtgcgctgcacccattaactcgtcatctagcattaggtatatctcccaatgctatccctcccccctccccctaccccacaacagtccccagagtgtgatattccccttcctgtgtccatgtgatctcattgttcagttcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcttctccagcatctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctggtggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttccagggtttttatggttttaggtctaacgtttaagtctttaatccatcttgaattgattttttataaggtgtaaggaagggatccagtttcagctttctacatatggctagccagttttcccagcaccatttattaaatagggaatcctttccccattgcttgtttttctcaggtttgtcaaagatcagatagttgtagatatgcggtgttatttctgagggctctgttctgttccattgatctatatctctgttttggtaccagtaccatgctgttttggttactgtagccttgtagtattaggaatccaacttacaagggatgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttacagattcaatgccatccccatgaagctaccaatgactttcttcacagaattggaaaaaactactttaaagttcatatggaaccaaaaaagagcccgcattgccaagtcaatcctaagccaaaagaacaaagctggaggcatcacactacctgacttcaaagttttcgttttttaaagcatctccggaaaagtttctcgtaaagcccagtctcttagagccaggtggcaacctttgatatgcaaatggaagccgttagaaactgggtccacccaaacatggcgattcccacactttcttggcctttccccacctgttcctagcaacatggccgcccccacgtatccccaagtgtgtagaacatcatgtgtcctgcatttgcatattagaaggctagggtgggagggccagctttttccagggctacatcaatgacatgcccaatcaaaccaatcccctaagccctatgcaaatcagacatcgcctcctccagcctctgtatacctagctggtatctggggcaggtgggtttccctgtctccgctttggagcccccgctccctctgtctctatacaggggagcttcttccttctcccttcttgccccttcttgcctattaaactctccgctcctttaaaaaaaaagaaaaagagcataatttgtctgtgagcagcaattattttcccttattggcagtcgggcatacatggagtattaatgctgcttcccattttgtcattttgggttcaaacccacctctgtagtagccaccaccgaaggcagattttggtagactttgaaaaacttgttctgcttgaggctccatgtgcttcatggcttgcaacacctaatggcctgcaaattctacagctacaatggtgagtccagctgctaccacctactagccatggctccagcctggctccccctgccaccacctggagcatggaccatcccagcccagaggtcactgtcaaaaacaacacgcctttaccggagagcaacacagccactgacagcaagctcaatccgcacaagtccaccgacagcaagcccaatctgcccaagcccacccaccgcgagcccaatctgcctaagcccacccaccgcgagcccaatccgcgcaagcccaaccacctcaagcccaatccgcccaagccccgactcatcagttcttcacaccccatatgctttctttttagagtgttgccccctaaaccattcatgatgagtacctttcaccatctgtttttttctttttaccctcttggaaaagaggaaggtcacctgaaggtcaccactggaaaaccttgctggctctggggagttattggtctgtgacactgttcagacttgggctgtaggcagtctggtacctgtgcagcctctcttttatttgtttacttttattgtaaaacctgtgtgcaaaaaagtatatgtagtgtaaagataaggtttaaagaatagtggtgaaaaagaacatccatttaccctccaccaagcttgagaatttttttttttttttgaggcggactctcactctgtcgcccaggctagagtgcactggcacaatcttggttcactgcaacttccgactgctgggttcaagcgattctcctgcctcagcctccggagtagctgggactacaggtgcccaccaccatgcctgggcaatttttgtattattagtagagactgggtttcaccatattggccaggcttgtctcgaactcctgaccttgtgatctgcctgccttggcctcccacagtgctgggattacaggcgtgagccgctgcgcaccgcagcttgagaatatgagcagcacttttgaagtccctacgcaatgcggcttccctcatccctcctttccctctctagcccatcagaggcaaccactgtgctgaatttagtatcaatcaaccccttgatattaatgtagttttttaaccacatattaaatatttaaataatgtattgcttagtcgtgcttccttttgaactttttatcaatggtatatagtatgtatttttctcaacatactgattttctaaatgttacttttaaaaaggtgtatctgtgttgatttagctacagtaattttaaaattaggattcatattccttataattttatctctggggaatttttgaggatcttcttccagaaaggactggggttttatttctccagatacctggagtattattaccagcccaaggcctcctacaaatacattttgggtttttttgaaaacgcaggtggtgtaaattctgactccagccctaaactcaggcaggcatttcttcatttcatttattgcacccagaacaaagtctgagaggggcctgtatcctcagttcatttctgtggggcaggtttttgtttgagtaaacccactgagtgtgttgacctttggggaatcctagtttttgtagagttctctcatttagattcctatacttctaaaaatgtaaagcaaataccaataaaatagcataccagatattggttatcttttgccctaatgtggtgtaacaagtcaccacaaaacttagtgatttaaaataataatttggccgggcgcagtggctcatgcctgtaatcccagcactttgggaggctgaggcgggcggatcacctgaggttgggagttcaagaccagcctgaccaatatggagaaaaccccgtctctaataaaaatacaaaattagccgggcgtggtggcgcatgcctgtaatcccagctgctcaggaggctgaggcacaagaatcacttgaacctgggaggtggaggttgcggtgagcagagatcgtgccactgcactccagcctgggcaacaagagcgcaactctgtctcaaaaaacaaacaaacaagcgaacaaaaacaataatttatttttgctcttgtgtctgggagtcagttagggtctgctggtccaggctgtgctcagctcagcttggtgccccgctgtgggctgggttcagcctgctccacacgtctctcatcctcctcagatccatagagcatgttctcctcatggcagtggcagaatttattccaagagtgcctagcagaaacatgcatgagcagaaacatgcaatgcctcctaaggtctagacctgatgcacttcctttctgcccatgctccgttagctagagccactcatgtggtcctcagtccaataggaaacatattctgcctctagtggaaggagcggcaaagtcacatggcagaaggtctagatacaggtagagaatcttgatcattaattcaatttgccacagggaaattgctttcctttacctctgcttgctagtgctgtggatctgtgctcactgaattccattctcaaacgtttacatttcctgagggtttgatttattactcaagtatgttcatctctactcctgaagtctctcaggtgggatattccagatgagatatttcctaaaattgaaaaaaaaaaaaaaaaaggccaagtgtggtagtggctcatgcctgtaatcccagtactctgggaggccgaggagggaggatcacttgagcccaggagtttgagaccagcctggtgccccactgtgggttgggttcagtctgctccacgtgcaagcaacaaagcaagactccatcactaccaaaaaatttttaaaaatgaaaaataaaaattagccaggtgtggtggtgcgtagttgtaatcccagctacttgggaggctgaggtgggaggattccttgagtccaggatttcaaggctgcagtgagctatatggcaccactgcactccagcctggatgacagagcaagaccctctctctaaaaaaaaaaaaaaaaaggaaaagaaaaaagaaaagaaaaagaacatcaggagaatgccaactcaagaggttcactgcttcccccagctttgctactttggcagggtagggctcctgagaacaggagttcctgtgggagaatcgtttcttacaacttactcatcatacgtcaggatgtcacctggtctctgggggtacctgtggataacctgtggccgggatgggtaggacaaggtaaaacaaaactcaaactcaggtgggtgtggtggctcatgcctgtaatctcagcactttgggaggccagatccacttttgggtggatcacctgagttcaggggtttgagaccagcctggccaacatgtcaaaaccccatctccactaaaaatacaaaaattagccaggtgtgattgtgcacacctgtaatcccagctacccagttgggcgaggcacgagaattgcttgaacctgggaggcggaggttgtagtgagccaagatggcaccactgcactctagcctgggcgacagagtgagaccctgtctaaaaataaaaacaataaaacgtgtcaaactcacacattttaaatattgattcttaagccactgaagaactatatcctcattgtgctgaaaaacaatgggatacaaacttgttctattttcaagacatctagatcttttgttatatttacaagaaagataaattaggtggtggctattcataaattaatgaaagattcctcactttataaaaggagttggtgcaaggtaaatttaagtagcaaacttttccaaaacattaaaaatttcatgcaatttgaaaattttggctgggtgcggtggctcacgcctgtaatcccaacactttgggaggccgagataagcagatcacttgaggtcaggagtctgagaccagcttggccaacatggtgaaaccccatctctactaaaaatacaaaaaattagccagctatggtggcatgtgcctgtaatcccagctgctcgagaagcagagacaggagaatcgcttgaacccaggaggtggaggttgcagtgagccgagatcttgccactgcactccagcctgggcaacacagcaagactctgtctcaaaaaaaacaaaattttttaaaaaattttcttacaacttttcagaaacctgtttatcacatataacaggaaatatttgcaggtctggggctatttttccattgtggtgatcagtatatatttttaatgatttcatttcatttttattaaacttttttttaaggattcatatatggttcatttcgtgtactggttaatgtttgttactttaagccattaaaaagcagaatttgagtcttacaattggacactgtttgcatattgttttagttatttctagttttttgtaaagtatataaatgcgtttttttcttccaaattattggtcggattgtgtaattattaagagcctttgatctgagggtccctgtgtgtctcatctctctctctctttttttttttttttttttcctgtggcggagtttcgctcttgttgcccagactggagtgcaatggcacgatctcggctcaccgcaaccgccacctcctgggttcaagtgatgctcccgcctcagccttccaattagctgggattacaggcatgcgtcaccacgcccggctaattttgtatttttattagagacgggatttctccatattgatcaggctggtctcaaactcccgatctcaggtgatccgcctgccctgacctcccaaagtgctgggattacaggcgtgaggcaccgcgcccggcctgatctctttactgacacgtgcccacaggggagcaaggaattcctaacttcagtagtaacttgggaatttcattgaaaagtgacaactcctttccatctttcatacttatttttcccaccatcttctgggttttgataattatcttttaggtactccaagagtactatgataggcttaaaaaaaaaaagaacagaaaaggagacagctgggaaatccaccagcagaatcaagttccatataccaaattattttttttcatattttcttacatattgtttgtaccatctcttcatcccactctactttcggagcgagcattattcctggaagaacttttgtattttctcggagtccatctgctctgaatacttatctcccacctgaggccatcatgttccattcggagcatcgtaatcattttcacagcaactaaacatgatttcacacacagcagattatgacttctgtggggagtgagcagtgtaaaatgattaaccccttaggacagggaccccatttcacactaatctccttagcaaccaacagaagacaggaaaatggacagcataaatggattgaggataatgcagcatcccatttaacgatcagttctaaatgcctccggaacatacttccaaccagaaatgatagctgatgccaaagagtattgagcaaatgtccctggaaaaggtggcactcgtgtggaagaaggacatgggaacatatgccgtaaagattgggggtccatcagggatgaagtcttgcctgactgtggtgggccgctgggccagtaggactcccggagagacagcatcacagaatgcatggatggtggggttccgaatggcttaagtctaaatgagttgattctacttttgtctagttccgttacgttttggggaagaagagctataccatgcataggtttgtgaattagttcttataacctccctataattacagaaacaaggataacccaaaggtcttgatttttttttcctaaaatatttctttttccctaaaagacttcatggcaattgaataccctgttttcagtttactattgctagttcaaggaagggagtttttactgggaagaagaaagtcaatctaaacaatgccacaactgtttgtttttttttaaataaccttccatgcctatgacacaggcagctaacataatgggttccattgtatttgaatgcttctgaagttaatgctacctttttctgcatgacttacatatagaggaagtcgggttggtttgtagccaatggctgttagatttgatgactaacagtaggtatctcagtaacaaaatgtttctctctccatcaccattaattttggaatcttcaccagagctgattgatcaactcagacaacactctttataaagtataatgaaattagaattttgatttagtcgtaaatgtggttacagggtgggatttgaaagcatcttctgtcattgaagagaagactatcatcaaagaaattaccggcatgctataggaatccaggcattgtggaaccttctgttaccccaggcaattattattattgtgattttcgactcggcaagtgtatggacttgaaaaaatcatctaataaacatttattattagctaccctttgcctgatagcagaaaatgagaaggaaccagatgcacccactttaattaattggtgtaatcaggagtggtatgcgacatcaagggtgaaaattgctgacttaaactgtggctttgtggctccaatgaagtcttgaagtcttttttccccttgaataacaacagaatcagagcctctggattttcctttctcatccatctgaatttctttccttttttgggggtggaggtgtgttcaattgaaacttttgatgtggtgataggattcccaatttttctgcaggagagttgggagtttattcctgagttttctcagttcattcaaaagaccaacaaagagaggaacaacatcaggaaatgtaatggaaacaatacatgttatcctccttttgcctgaacatggtacagattgaagtagcaaccctctgcttagaaaaaccttttctgttgttcccgactaagcaaaccatcctttaggtctctgcttagacatcactttctctgagaagtcttcccaaaataccctccctcccaaaccaccctaccctccatccttcctccagctctgttaggcttccttattcccgtcttagcacttcatccactttattttagaattgcctatttattgtctatatcctcttttacttggggtcaggcactgtgtcttgtcacctctatatctccaggatctaatacagagcctagcattcagtaggtgcttaatcaaacctttattgaatgaatgaatgaatgaatgaatgaatgaatggaagtagtgtctgtctcacctaggtataccttactcatgtctgcattttcagtacctactgtcactggaaaggagttccgatccagactccatgagagggttcttggatcttatgcaagaaagaattctagatgagtccataaagtgtaagcaagtttattagagaagtaaagaaacaaaagtatggctactgcacagacagatcagaaccgagggttgctggttgcccacttttatggttattttttcatgatatgctaaacaaggggtggattattcatgcctcccctttttagaccatgtagggtaacttcctgatgttgccatggcatttgtaaactgtcatggtgctggtgggagtgtagcagtgaggacgaccagaggtcactctcgtggccatcttggttttggtaggatttggccggcttctttactgcaacctgttttatcggcagggtgtttatgacctgtatcttgtgccaacctcctgtctcatcctgtgattaagaatgcagcccagcaggtcacagcctcattttacccagctcctattcaagatggagttgctctggttcaaatgcctctaaccctacttggtgtatcagttatctattgctgcataacaaaccactgcaaaacttagtgtcttaaaacagcagctatttagccatgattctgcagactagcagtttaggctggcccagctggtcagtgctggtttcagctgggctccctcatgtgtctgtggtcagcttccaggccgttgagtgctgggtgttctaagtaggcctcagctgggggtgttgtctcttttccctgtgatcttttatcttccagaaggctagcctgggctttttcaagtggcaactgggcagggctgtaagaaagggagcagaagtatgcatgacctcttgaggcccaggctcaactggcacatcatcacttctgctgtattttcttggctgcagaagtcacagagccagtcctgacttaaagggaaggaaaactgacttctttgagaggaggaactgcaaagataggttttaaagaggcagggatacgtggaggagagtaattgaggacatttttgcaaacaatctattattcttggcatagtgtaggtactctaaagcacttgactactttgagtccaacaagtattagatttagcccaagtcttggaaagtcttccaaagaagataaaatttctctttggttgcattctgaatccctgcccttccccatctcctattccctgatccctccactgctttgtgacccaagcatgcaggccttgtgtggctgtcagcgcccaggtcctcctattcaatgggtgatacatcctggacacctactgttctcctgagcatcttgtataaactagaccccacacccgacgggaccacagcagtgagcaagaaagacagattcctgttctccactgggaaagatggatgtttgactagaaactacgaaatggatgtttgactagaaacaggtaacagaggggacctgccttgttgaggacctggcatttaagctgcgacctaagaggtgggtaggaaggggtgttctcgccatggaggaggtggcggtgacagtgtggggcccagagacggtacggtggagcacttttcagagagagggagtgtgcagaagggccctggtgcaggaaactgggagaggacagaatggcttcagctcaggggtgagggatggcagaggtgtgccagaccgggtctcctggggctgggtgagccaaggcactttcccaagagatgactggaaagctgttgaagggttacagacacaggggaggtgacccaatttactttttaaaatcatcctgggctgcatagataatacatgtagaggcgtgcaaggctggacatgaaattccttccattctccaccatcaaaacactctacccagcggggtgtgaggaagaaagcaatccgatgacatcgaattcgcactaaagttactgagaaccttgtcatggtatttgttcaaatcttgagtgtgcagtcttcgaaaccctctgagctctgttccagactgtcctctcagccttgagtgcacatggggcaccggaagctggtgcactggggaagagagggaaccgtcactgccagctgcccggtggtgcaacccccattcattctgatgtgggctggctggctggcaaggcggcagaggggctcagtgtcgccgtgtaagtcctcaaacggtccttgctagtggctcactttagaggggatggtgcacggctccttttcctcgggatctcagagcaggtgcttcacctgcctctacttcccccttgcccatattccccccattgggtactattttaccttttcattggatgtcatttaaaaaatgtggtaactcagcaacacctttcactgccttaggcatctggttttctgtgtgacacagaggccttccttctggcgctgtctcccgggagcatcttcaggcagcatttctctaacttcactgaatgattctggaagtggctggcagatcactgtcagtggagtcaaccagatgtgtatctgctaggccatttccctttccaccttccctcggttctcgctgggtcacagaagcaatgtcataacaacacagcttcctcctaatgaaacatctgcagccaccctctggctgacagttcattaaccttgtggcccaaactgcttcggtgccgtccctgctcctgaattttaacattcagagttttcttcaaagcccaggtctgcttatcaatcatgttcaatattaggttacttacagaatgaagtcattatctttaatgtttaataactgtgccacaaagataatataataaaatctgagaaatgtaattgagagaggcttttgactcaagtcttgtgtgtgtgtatgtgtgtgtgtgtttaatctttcctaatcctatccccaaggctaagaaaaaccttgttttcgctctgtcttctacttggtttgtctcttttgttttgtttttgcttggcaatgtcctgatcagtctgttttggtgatggctgagtctggggagctggcagcagagatgatgacactgggattgacactatgctgcaggagggggtggttgacggccacaggagatgttgtggggttggacccttgcagggcatggatttggtcaggtatggggaacaaatgaccagcgtggactctgctcctgacacaaatgaacaaagtgcccagatctgattcccccagccctggtggcttccaggtctttgaaggtagaattgagcctcacagcagatggctcctggtagtgaagagattcttgggcaaaagcctggtcattaaagaaggaagatttctttctttccttttttttttttttttggagatggagtttcactcttgttgcctaggctggagtgcaatggcgcaatctccactcaccgcaacttccacctcccgggttcaagcaattctcctgccttagcctcctgagtagctgggattacaggcttgtgccaccatgcccggctaattttgtatttttagtagacatggggtttctccattttggtcaagctggtcttgaacttccaacctcaggtgatctgcccgcctcggcctcccaaagtgctgggattacaggcgtgagctactgcacccagccgatttctttttatttttttgtttaggaaaatgtataaaatggaatgtagtcattttgctttgtcttcttggaagaagcatcaatatgaataagtctttgaatttgcaagttaaaactctgattttccatgggcagaatccgggtgagaaataagtctgtttgactgttttgagttcttcctttaaagaatatagaccatgatggtggcctgtgttgtgtcctgaggggctgtgtacacggagtctatggcaaggttcataaaacgcttagaggtttttcagagaaaggagctatagaaatggaaggtggcacagttgtgttggaaacctcccacggggtctccaggctctcatttccctccaagtcataaagtgagaggatctgtggtaagtctccccctctcccctcccctccctctcttattctgttctcaaggcaagaagcaaagcatgagggtctaactatacaggacaatccttccacggttcctctgcgcagtcccatcttacatctttggaggagttggatagcttttctttcaaaattttacaataattcctttcctttttctgaattgctttatgagttgacttgtcttcctaaggagtcaaagttaacaagactacccttgaacaatgtgaaactcaaccaggtatgtagcaggcttttggttttttatctaaatggttgaatttcttttttggtctagctgtattaggaatagagagaagagaatttctggaagtggagaccaggaaagggttcagactagttcttattattattacttttttttccctgagacagagtcccgctctgttacccaggcttctggagtgcaggggcatgatctcggctcactgcaacctccacctcccgggttcaagcaattctcctgtctcagcttcccgagtagctgggattacaggcacccaccaacagacctggctaatttttgtatttttagtagagatggggtttcacgatgttggccaggctggtctcgaactcctgatctcaagtgatccacctgcctcggcctcccaaagtgctgggattacaggcgtgagccactgtgcccggctgggttcttgagggagccaggctgagttctgcagatgcttctgtttttgactgctctcatattttctaaagtacatcctagtctctttcaactcatggggaaaattgcagagagttagggcccgtatagtatgtgacaccaatcaagacataaataatgaagcataaacatgtttttaaaaaacctgttatttgggatggagagaaaataacccttttcaaacattcgatataactttatacatcctagggaaatgtttacacacaccattggtttaaaattttagctgaattattttgatacttcagttcaacaaatggtcaattcagtcagttttttaattgatttttcacaaaatggaaccggttgactgcttgactcaactagtcatttgtgtgatacagacgcaggcttagaagaataaggttgaactgggcagtggcagatggctaaggtcgagtttaaggaagacacagagaactctacccatgggtccgtatcatgggttcctgtcctcacatccatatcatcagttcatttagtgaatgaaatcataatccctgcctctcaaggtctcatttgatttcacattcagtggcgttttcagtctgtgttgaaagcacatgagatgttgacgcatttgcacacatggtgagccaggaaggaggtgacgagagtgaactgggaagagatcatttgaacattagagatgacgattctgtttactattttcttaagtccttactggaaatattacttttcatggactagaactaattggaagtaagatatcctgtaagtccatttagaaaaaattcttccaactagttctgagcacgctggatttgcctgagaaactctttgggctgcattctgagggtggcttgggtggatttgccttgacttgatggccttgaggaataaggaggcctgaatgggcgtgaaactgtgtttagaacttgagttggcctgacacagctctggttcacacttgaacttatgtggacacttctctgcctctccattattcatctttgtacctcctgcatctagcgtaatgttgaacacatgacagacgttcattagatgttcagagtctggttgtttgccagcctaaaatgcttagagtttattgaattgggttgtacatgctactaggacctatgactttggggaaggaagttttagggttcagcaacctttcacgttttgtctttttttttttcttatgggctaggatatttacccaaggtaaattcagagaacaggggtgcgcagtgttacatatggcattccccacttaggagcaagtgactaatatctgtgttaactgaagtctgtcttctcacaggttctgtgctgaagaaccatctcactggctgacaccccttaataagacattctgaatctccatgattacaagattggagtgtgttcagaaccagaggcaagcagaatagttcagagatgtgggtcgtaatctgagtggggatataagggccccgacacaggtgccaccgggcagctgctggaagtgggtttggagccgcacagtgtgcaccaaggtcagtcctgggtgggggacgtgcagccaaaggaccatccctgcgggattcagactccagatcccctgctttcccatcgccatgggatgcccagaatgttaggaacaaaatccttgctcacgaagtcggcctcacttttccctgcccagctactggcttccacgtcctcgtctttatgaactttccatcatgtgtctagaattccatcccctctgctccctgctgattcatgcccgccattttcctagggagctcagtcaacattcagctcttcaaaaattctttttctggcctcatctcaggactgtacttcattttgtagtttttccacacagaacttgtaagcactcttgaatcatttcatttatgtcccgactttttagctagcacgcttaagagcaacacaggccttgtttttctgtgtatatgctgaagcaagcagaactgacctacccaaacttaatagtatgaactgtgttaatataaattgtcagctctggagattttatttgattctcaaagtaactctgtgaaggccaggcatggtggctcacgcctgtaatcccaacactttgggaggccaaggtgggtggatcaccagaggtcaggagttcaagaccagcctggccaacatggtgaaaccccatctctactaaaaatacaaaaattagccggtcgtggtggcacacacctgtaatcccagctacttgggaggctgaggcaggagaatcgctcaaactcaggaggtagaggttgcaatgagccgagatcacgtcactgcactccagcctgagtgacagagtgagattctgtctcaaaaaataaaaaagagcaatttttattatttccatgtttacagatgatgaaactgaaattcagagaggccaggtgacttaactaaggtcacacagccaagtggaaggcagaggtgggatttgagtctttgctgattccatgtctattattctttctactgccatacactgtctttctggtttgctgattcaataaattttgccttgaaaaattagagtcacaattgtcttttgaaagcctttctttggaggaaatatcctctgagaaactatgattttttagaaaataattggacttagagaaaaggagtaggctctgcctaaggaaaaaatgtattacttagtcctttatcaaacatttatgggtttactctgtactgtgctagttgatgggagtgggactagggtcaaatgaggacatggtttctgtcctccctgaacccatagcctcgtggcttggagatgggacaccatggtggcagatgttgtgtgtgcttgtgaatctgaaagactgatgcctgatgggcatcagtttttgtttgtttgtttgtttgtttgtttttgagacagagtcttgctctgttgcccaggctggagtgcagtggtgtgatgttggctcactgcaacctccacctcccaggttcaagtgattctcctgcctcagcctccaaagtagctgggattacaggctcccaccaccacacccagctgatttttgtatttttagtagagacgggctctcaccatgttggccaggctggtctcaaactcctgacctcaggtgatctgcctgcctcagcctcccaaagtgctgggatgacaggcatgagccaccgcgcccagccctaatgttctaactcataaggaaattttaccttcattcactacgagtaggctcatactatacaaatattagtttctagagtccattgatggatgaagagataaacaaaatgtggtctatgcatacaatggcatattcttcagcgtggagaaagaatgaaagatacgtgctatagcggtaacatgaaccttgaagacattatgccaagtgaaataagctaaacacaaaagcacaaacattgtatggttttgctcatgtgacaggcaaaatcatagagaaagaaagtagaatagaggttgccagcagctagagggagggagaatgggtgccgagtttcagtttgggaaagtgaaaaagttctgggcatggcgattggtgatggttgcaaaacaatgtatgaaccactgcattaatgtacttcatgctcttgaatagtacacctaaaaatggttaaattgataactctcatgttacatataccacacagaaaattagttttcagaatagctgacaagctatgcttagatatgtctttaaggcaggaggaagatggcagtggtcatagcagtgtgtggaaagcaggagagaccccacatgtcaccaattagctctccaaatccagaaaacatcagggatgaacagcctccgctgcccatgatccgcgagctgtttcgctagcattccgaacaattctggcaaaggcggaaacactggaccaggatctgggtgactctttcacagttgattgggtaaggagaagcgctgttctcagagaaatgagaacatgtgtcttggaaggctgcctttgcttaatgttctacacgatccaggaggccagatggcattttatgtggttttcacaactgtgattttggattgattactaaacctgtttgtgttcctaacccagctcgctgcctcccgcctgccttttagcttaacgctcattcccagagctcagtttgaacaggcgcattgtttttattctgttccttattattattgcgttggtgccagcctttactaccttcagccctatttgctgcccagagtctagtgcagaaaatgaaatcctttttccaataagtgtgatcaaatgaaaggctgtcacactgcatttacatccaattctgggtttttttttttttttttttttttgagtttgggtcgcccacatgatgggttgtaaaaggataaaggataatttctgatgtcgtgccagcttttcctcacccagctgaccttctactatcagatggtattttcataggaaaggcaaattaattttatatctaatgtaagaaaaacattattaggaagattgtaatgaaaattaagtagtttgcaaaatgttttagaattttcatattacttttgcataaaaaacttctttcagttcttacaacagtcctgagacagagttcagcaggtgtccccatctcatgaggaaacggaggctcagagaagttagggggcatgtccaaggttgcccagctaacattggtcagagctggatctggagagcttatctgcggggtccacatccagaatgctttctaccgttctgctgtaccagctggaaaacaaaatcccattcgagtaaataatatcagcaatagccaccattttaagcaacttaccaggccatttactaaataagtctccttgtactgtagtaactctcatgactaaggtctgcagacgacccatttaataggctggcaaagtgagtcagagattgcgaggagaggctgagagcttcctgggaacatctctgttgatgtcttgaactgggttcccattgttccagcagggaaactgaggatagcagacattgcaaaatgtccttctgtgaagagacttctagtcgttttggtgaaaacacagtgtcctgctgcctagctgaaatcctggtatggataagtttatcttatcatctttctatttctagtacttggcccagatcgtgacctaacagcaactatttgttgagtggaacctccaaagatagcagtttcttcttgtggggaattacagtctattgatttgctcaatgcaagttcattttattaagatttcttcacctgtgtgtttatataaatagacagccaggcagtgcatgaaagtggctgcccggccagagtctggctgggctgcttcgttctactctggggattggacccagtagaattcttggacttggtgtggagtcccaggtcaagccaactcattacttctacctctcctttttaaaaagggttttctgtctttggttcaagttcctcttaaaacacaatcatcatcccttcattgatagaggcacaaatgaattattttttttcttttttcttttttttttttgaggcagagtcttgctctgttgcccaggctatagtacggtggcacgatcttggctcactgcaacctctgcctcccgggttcaagtgattctcctgcctcagcctcctgagtagctgggattacaggtgtacaccaccacacctggctaatttttgtgtttttagtagagacggggtttcgccatattgaccaggctggtctcgagctcctgacctctggtgatccacccgcctcggcttcccaaagtgctgggattacaggtgtgagccaccaagcccggccgaatttttaatttttttattgaaatggagtctcactctgtcacccaggctggagtgcggtgatgctatctcagctcactgcaacctctgcctcctgggttcaagcgattctcctgcctcagccccccagtagctgggattacaggtgcgcaccaccacacctggctaatttttatatttttagtagagatgggggtttcgccatgttgaccaggctggtctcgaactcctgatctcaggtgatccacccgcctcggcctcctgaagtgctgggattagaggcgtgagccaccacgctcggccgaggcacaaatgaatttaaacctcattgaaatgacagcggatggccatggctctactgtggtttccctgggccactttcttctcccgccttcctgccgcatgcaggagtggaggccgaggctccctggccaggctgctctgggttattacagtgatatatcttggaactgagcttgagcagggatcctcctgtttcctgttggaattgattttctgtccaactttcatttcctattgtgcattcctttggggtcagagcagctttctcagacaaaagcagggctttctgttttggagatattcctggcgtctcttcagctgcgtgtttatagaaatggacagcccggcagtgcatgaaagtggctgcctggccaaagtctggccgggctgcttagtggtactctgggggttggacccagtaggattcttggacttggcgcggagtcccagatcaccctgtcattggccctgtatcttaacttgtaggcacgtcttcatctgtcagatgggctttgttctctgaagcccgcatcagagagctcttcagaagagaggaaatgttatattgctgttatcatttcaaatgcttaccgctaagtgaatctggttcaaagcttaacagcctgtgggtgaaccgcaaaagctcaattggatctcaaagaaatccctggtcaagccctgtgccttctagtacccaattatttatcaataagtgtgaagattgcaacctccagattattcagccattgttgagatgtgtaaaaacggtatccccagcaccttgaaaggctaagtaggatcaaccccccagttgttgttcactttctgtgtcctcagaatccacttttgtttcagtccttctaacccattctcattgttttctgtcagtgttggaataagtggaatagcagggtccataaactctaccacttgattgtcaggaatgaagaatttggttttctctgttgtcataacattcgtgagtacatctgtaagcaggcattttcccatcatctttcccgcatttctaatgaatgtgacatcagtctatttgctgcttcataatcaaggtcctgtttgttgatatgtaatcaaagcaaccggattatgtttgtcagtacgagtcagaaaaatctaatatatatttactctgatgccataaggagtgtcagcctttgctggcctcaataatctcgtcttgggagagaaagctcataatgtggtgaagataccgttttgggattatttctagaacgtgatagttgtgccgtgcacatacatgtccaaatgcattgagtcatgtgatagcatccagttttatgcaaccaaaattggacattatattgtttggatagagtgctcaagatgggtggttcctggatagagtgttgaaggcagtggtgccatcaattcagcagcaaggaacttaatagctttctcatcacagtcctcacctcctccctcctttttctgtgtcacagaagcagtaagaaacatcgaggaatttcccaacatatcagggaatttgttatttcttctaaaacataaggaagtacgtggcaatataaatggcaaatgtgcggggtgcggtggctcacacctgtaatcccagcactttgggaggccaaggtgggcggaccaagaggtcagcagtttgagaccagcctgcccaacatggtgaaaccctgtctctactaaaaatacgaaaattagctgggcgtggtggcgggtgcctgtaatctcagctactcaggaagctgaggcaggagaatcgcttgaaccttgggggcggaggttgcagtgagccaagatcgtgccattgtactccagcctgggcaatagagcaagactctgtctcaaaaaaaaaaaaaaaaaaaaaaaaagaaagaaatggcaaatggacatttacatggtgattagaaaattagaatacaccgggaaatctgggttctgttctcagtcctacttgtaacacatccactgaccttaaacacatttctttactttgctgcacctgaattcccttatctgctgtaaaatgaatttgttgaactaaactaaatgttctttttttttttttttttttgcgacggagtctcgctttgtcgcccaggccggagtgcagtggcgcgatctcggctcactgcaagctccgcctcccgggttcacgccattctcctgcctcagcctcccgagtagctgggactacaggtgcccgccaccacgcccggctaattttttgtatttttagtagagacggggtttcaccgtgttagccaggatggtctcgatctcctgacctcgtgatccgcccgcctcggcctcccaaagtgctgggattacaggcgtaagccaccgcgcccggccctaaatgttcttaaagatcctttccagccctgacattgaactcagtacatcaacttacatgatttattcgcacaatcttagcagaattaatttggatttgttaattgtttgcatctggctaattattgcctgcacaccgtaagactatctaacagtagtagtttcttatattaactaaaggtgctgtgaaggaaacatggaattcccccaaaatcaaaactaaaagaaacttctgctttagagcaaacactgataaaatatacataaggcaccctagctgcactgggcccttctgccctcttcagcaagtcctgcctgaggtgcacacaattattactggctcttgtgccacaaagtgacatcgtctttggctgtgacaccacatgaagagggaaggaggtgtgagactgtgaagacactcagtacaggtgcagcctcctccacagagtaaatgtgatacttctcgagttaatgactatgttgggaagttttccaactccaccatcttccctgcttcaacgaggatcccagggggaagctcacagatttgcagatctttttacactaaggaagaataaagcagcattccagttgcaggagtataagccagccacagacccagggggcacatcttacactgtctttgggagaaagaaaaagtactaataacaaataaatctgatgggatttcagatggattccagtctcattcttttgtgatagcagggagtgaggttttgatatattccctctagagatggttctaaacatggagacccatcgatatccaggtatacctcctctcctctctgatcaatccaattgctaaacaagaccagagcaaggctcagtagttgatggcaagtgcttctgctaattgccttgcgattggggaatcaggaggatgtttttattcaggaaggcatgtctgaccaatgaaacaaaatgcagttggtatcattttagatttggctcttgaatcgtcagaaatatgtgccttcactaactttgaggaggaagtatcccttctctttgggtatctctgggaagttgctttattgatttttcaccagtttgcagacaagcccaagtctaaaaaaaattcagatgtagcctaatactgcaagcctttcttttatctgtctatctatccatctgcctgtctgcctgtctgcctgtccatccatccatacgtccatccctccatccatccatccatccatccatccgtctacctacatgcctgcctacctcagcctcccggatgtttgaggctgcagtgagctatgatcacaccactgcagtccaaactgagtgattcatgattgcaccactggactccagaccaagtgacagaacgagacagacccatctttaaaaaaaaaaatgattatgagaggtctcagtgcagaaatggcttcctcctgcccattgtgccagcttgcccaggcccagaggttgagtcatgatatgaatgtgctgtgtagtgtccagcaccagaagtgtgggtatagtggaggaaaaagatacagagccagaaccaggacatggaaacatttttaagctatatgtttttaaaaatcaccacccccatgctagagagaggactgaattaggtttctgttttctctctaaaattgatataacaaaattgttgtcatgtgaagagaaaatcaaagagtatgctgacaaaatatgtgggaaaatctaaagcacagggacaaacgaaaaaaatagatgacttgggactatatcaaaatggaaagctttttttgttgcaaatggtaccatccagaaaatgacaaaagcaacccacagaatgggagaaaatttttgcaaatcacatatttgataaagaacctgtacccagaatatatgaaagactcttgccactcaataataaaaagacaagtcaattataaaaatgagtaaaagatttgaatagacatttctccaaagaagatatacagatggccaataaacacatgaaaagataattcagcagcattagctatcagggaaacacaagtcaaaactacaatgagatacccctcatttatactcgcatggctagaataaaaaagataaacaatatgaagtgttgatgaggatgtggagaaattgaatccttatacattgctgttgaaaatgtgaaatgaggccggtcgcagtggctcacgcctgtaatcccagcactttgggaggccgaggcaggtggatcacgaggtcaggagatcgagaccatcctggctaacatggtgaaaccccgtctctactaaaaatacaaaaaattagccgggtgtggtggcgggcgcctgtagtcccagctactcgggagactgaggcagaagaatggcttgaacccggtaggcagagctttagtgagccgagatcgcaccactgcactccagcctgggtgacagagcgagacgactcctcaaaaaaaaaaaaaaaaaaaaagaaaagaaaatgtgaaacgatatagcccctgtggaagagaacttggcactttctcagagagttaaacacaatgttatcatatgacccaacaattctacccttgttatgaaaaaacatgtatccacaaaaccttgtacatgaatgtttatagcaacattattcataatagcccccaaatagaaacaacccaaatgtctatcaactgaagaatggataaacaaaatgtggcatgatctatataatggaatattacttggcagtgaaaaggaatgaagtgtggttcattcattgaaatattatggtaagtgaaagaacctagacacaaaagatgacatattgtatgattcctttgatataaagtgtctagaagaggcaaatctgtagatacagtatgtagattcctcattctcaggggctgaattgggacgttgcagctaatgcatatggaatttattttaggagataatgaaaatgttctaaattcgatgatggttgcacaaccctgtaaatatactaaaaagcatagaattgtacaatataaatggatgaattatatttcaatagagctgttttaaaaatattgaaaaccagagatacctgtctgtgctctaaaatgtatccactgccttctagatacagtctaaactctgcagcttggcttttaaagccttttatttatatggaatcctccccaccccccaccatctatacatttgtaaaccttacatgttattcaaatgccataattcgtcaaactggatatgttttctccttccagaaagatattccttcatccctcttataagccttagcactgtctgccttgcgttatatttatttctgtatctgtcatatgatctctatctgatcgagagctctttaaggccgggatgtcggcttgctcatattggcatccttcaggacacctgacccctaaacttatctgattggtacgtgatacatttttatcactggatagaatgaatgggttgtgaaattattagatgtgatcccagataggatactgtttttactaatctctttcacaagggtctttcaagaacaatgcaggatcaaacttataaagagatttttgaaactctcaaaactctgtgcagggtattattattatctgtaatcctggtaactattcaaattagtgtcaattaacttttggctgcactcttaagattctttatcatctacattagtttgtcagatgaggtaatgcactttttctgggtacagttgtctttgaagagattggcagcgtttcatagttgtaaacaaaaccgtctcatatgccggaccgtgacaaagagggactaggacgccagaagctctgtgaaaacacttaaatccatttcagcgaggaggaattgtgatctggtaaataaattagtgttctgctctgttccttggctcctctgctaatgaatgggccccagagatttttttttgtcttgggtgataagcccctaatatctattcaagttcagcataaagctcattttctctagaaatctttgtttaaaaacagaatttttccagtaaatatatttatcaaattaaaagtatttcagatacacagagagtgatataacaaacaaaccaccgcctgtgtctaacaaatgctggctttttgtcatatctgctttggatgtttttttagttgaaaaacatttcgaagatagttgaatcattcctttccttcccaaatctcattgcccctccctccctttcctctgaagccacaattatctctaccaggaatctctctctctcttttttttttttttttgagacggagtctcgctctgtcgcccaggctggagtgcggtggcgcgatctgggctcactgcaagctccgcctcccgggttcacgcaattctcctgcctcagcctcccaagtagctgggactacaggtgcccgccaccacgcccggctaattttttgtatttttagtggagacggggttttaccatgttggccaggtctaccaggaatctttaactggttaatctttcagtccaactttgatatcaattgttaactcttgagaccattttctatttcaaaactgtccatctgactcgtttctattactctgaaataatagaatctcagaattctgtgatctaccttcaagccgattaaatgggaatttttcccagagagagtttaaaccggcctctgggttaggggagaagtatagaccccaaagacccttacagagaaatacttgtcatcacgctcctggaattctgggagagggagaggcatgagaaggctgtgtggccttgtctttgaaatacagaagtttggtgacgcctggaacattttttacatgacaaatatggtgaaatttaacaggctatcaaagtgcagatcaggccaactgaatagcagttttggggaaaatgacaaggtgctaggtagtggagagaggaagattaaataacctacttgggtctatgtgctcgtgaagacacgctcatatgtcttccttgcatggatacctgccttgctctaaaataaacttgaagtgtgtttttaaaaaaagcatgtgtgcagcctgggtaacatagtgagaccttgcttctacaaaatacaaaataaaaagagtagccgggcatggtagcgtgcacctgtagtcccagctacatgggaggcggaggcgggaggatcacctgagctgaggaggttgagtttgaggctgcagtgagctgtgattgcaccacttcaccctggcctgggcaacagaataagaccctgtctcaaaacaagacaaaacaaaaacatgaatggaacaagaaagaatcatgaggtgaggaaatgaaggttaagggaagatgaggatcagagggagtaacaggttcagttctaagatgaggtccgcatgtggaatacataccattaggcacgaagctcgggctggaagtaccctacagactgcaccatgagcttctcaacagacagtgggtaaaggagtcagtgacagaatctagggcttttaagataaaagcaaaccagttggccaaggaagaatggctatttccagcacagatgcctgagggccattttttctgaggatgtggctctcacccttgatggacaatcaggacattctagcaaatgtgcattgtgctctagaggggtgtgtgcagggagcatagctgagggatggaggggctcatgtgcatcaggattgcctggaataccagggattattagtgccaataatgctgtcaatgacgttgtgatggttaattttctgtgtcaacttgactgggccgcgggatgcccagatatttggtcaaacgttgttcttgggtgtgtctgtgaacaaatagccctcactggtgcaggtgagtctcatccaatcggtcgaaggcctgagtagaactggccttcccgtgagtcagatggaagtcctcttgcctgactgctcgatctgggacatgctgctttgggactccagctgaaacatcagttcttcctgggtctcaaggctgccagcctttgggatggaatgacgccatcgggtctcctggttctcagccctttggactaccactgggactgtggtgatagtctctcttgggtcgccagctggccaactgcagatcttgggatctgtcattctccatcttatgataaatcaataaatacctctctcattatatatataatatataatatgaaataaattaataaatatctctcactatatatagtgatatatatatattaggtatattttatatatatgtatatcctattagtcctgtttctccagagaactctggcgaatacagacattccatatgcaaagagaggccgcgtggtcttaggtactagttgtaaaattataatatatattatattatatataatatttaatatatataataaatcaataaatatatatctcactatatatatctcttactatatatataaatcaataaatatctctctctcactatatgtatatatatcctattagtcctgtttctccagagaactctggccaatacaaacactccatatgcaaagagaggtcacgtgatcttaggtactagttgtaacattataatatatattatatataatatttattttatataataaatcaataaatatatatctcactatatataaatatctctcactatatatacatatcaatcaataaatatctctctctcactatatgtatatatatatatcctattagttctgtttctccagagaaccctggcaaatacaaacattccatatgccaagagagatagcgtggtcttaggtactagttgtacaattattttacatttgaagaggtaaacctttgggttcataggctttctaactgatgtcatggagtggtgggagggttttgttttcccttatccattaactttattcttaaaataacaatatcactaataacatttatggcatacttgtaagcacttcacatatattctctcacttagcatcatgacaatattctaaggggactgaggcactcagagcttaggaaactcgttcaaggtcacctagctaggaaacgatgtgctgttttcaaggccctcatctgaataaaactatcttccctttactctcagcggtgaaaatgggggagagatctgtattggaagctcattcagatgttgccttcttttgcactcgaaggctttgctctctgaaggcaggaagcagcaggcacgtgtgcagggaaggctgtgtatgtggcatgtgcaggcagcagcagcaacgcgggacgatggggagagagcccaggggagggaggatgcctgcagaagcggctgtgatgtgtgggaagccccgctgggccggcactgtggaaaggtgacctgcagagccacagctgcaaatgaaccactaattttcccatctctgcttgcaatttacaaagcactttcctggtgtcatgagtagctcccaagtatcagagcagggattgaaacttaagttgtttgacgctacactctgatttcctcaccccacctcactgtcttgccagttccaactgtacccctcaggaatttctatcaggagtctgtgtcaacatcagcatgaagctgaagaaggagaaaggaaatggggcaacaaagcacacagatgttcctaaaaagcaaaagcggaagagagaagctagactcgcctgtctctggtttttctcaccgcctgattgttcctttcagatgacccgcatctctcggagctgacctcagctcagcaagggtgcctgtgacccatggagcagtggccactatctctgcattgtgggagggtggtccgtgttgggtctgcagggtcgttgtcacagcgatgaatgtgtagatctgtgcttgctgaagctcaggctggtcgctgtcttgtcatcgtctcctgttacacagctttcaggctgcttttttggggaagttagactcgcctgctcttttttggggaagttccacctcactgcagccgggtatggtggtttgctcctgtagtcctagctacttgggaggctgaggcaggaggattgcttgagccaggagttcgaggctgcagtgagcagagatcacaccactgcactccagcttgggtgacagagtgagaccctgtctctaaaataaaataaaataaaaataataaataaataaataaatcaccccttggccaggcgcagtggctcatgcctgtaatcccagcactttgggaggccaaggtgggtggatcacctgaggtcaggagttcgagaccagcctgggcaacatggggaaaccctgtctctaccaaaagtacaaaaattagcctggtgtggcaggcgcctgtaatctcagctactcaggaggctgaggcaggagaacggcttgaacccaggagacagaggttgcagtgagccgagatcatgccattgcactgcagcctgggcgacagagcaagactccatctcagaaaaagaaacaaaaaaatcaccgtttaactcagaatcagccacgctgaattgaggtgaggttttatgcatatcagattgaagacctcctccggggagtggtaggctgatggcttagtcatcctataaagagcccagcatctgactgcacagctgggtctacctacagcatggagatggctatctgggaataatgggcactagaattggaggatcctgatgaaccacttcctggccccttgcttgtgccacctcccttcccgccaggtaaatattgcttagacacccagcttctgattaaagccacatgatggaacttgtcctaaggatgcaactgatggcccgtgtcagcttgttggagttaaaaaatatattttaatttgtttagctctctggggaaattatctgagcctgcatgtgataatcaactttcacatgagctttcaagagacctgaaatgatttgagcaacaaaatgagatttttaatctacataaatacaggagtcgtttgcctctctttttgtgtgtatgcgagaggaggggagcttaaaacaattctaattcattccttttcttctcccctaggacactcattagcaatggtaggaaaatggtcacaggagtggtaccttgcctcacattctcacacacattttccctttggactttaaacttcacatcaactcttaaggtgggggtgggcggtagcaagtgttgcttcccctttttatggaaaaaagtaggtctcagagaggttacgtgacatgcccaagttcatgtgctggtgggttgcagagtcagttctagagcccagttctttttggaaactggatcaatgctctttctacctcaccagctgtctcatattaatactagagatactaatgcaaaaacactaccataatagtatctgcaagagaacaaattcaagggaagatggatggatactggccgggcgccgtggctcaggactgtaatcccagcactttgggaggctgaggcgggcagatcacgaggtcaagagatcgagaccatcctggccaacctggtgagacccgtctctactaaaaatacaaaaattagccaggcgtggtggtgcgcacctgtagtcccagctactcgggaggctgaggcaggagaatcgcttgaacctgggaggcagaggttgcagtgagccaagatcatgacactgcacttcagcctcggcgacagagtgagactccatctcaaaaaacaaacaaacaaacaaacaaacaaaaagatggattgacactgcacctgcctgcatcagccaggctaagctgggttaagttgtggctacaccagatgtctatggcttcactggtttatgcaaagtcccctgtggggccaggtcactctccagggaagatctcatgacttccatgtcagcaggacttagggtgcactgaagagggaaagcagactgaagagctttgtcgaaagggtgtttaagtttggcagcccaaaaatgacagagaagttcatagccagtcacagcctgtgggctggctctaattgtgcagccctgcccgatgcacgggcggttgtgaaactgtgtcttccgagtgtgtaagaaggggagaagacccggaaatactggtgaccactagccatgagcaccacatggtctgcaggtctgagcggtcaaaagatctgttctgtggagcaggctcccctttaaccatgtccctgtcacagatcccgcggcaagcattcacaccacctggaattaatcgggaagaaagtcgcagtgtttagcagatatttcacagatataaactgtgcggtcttcctaagtctctgcacatgatcagctgaagattgggcttcttgtggtgcacataccattttcgtcattaaatccccaatgactcaccttgtcctgaaactgttaaagctccttagcaagactgaggcccatcctgatttgggccccgacaccctccccagtctcttctttcatggcacccctcctgtcatctgggtttgtgaagctcctttcagtcctctcaaaagagcgtttctctcttccccctctcgctctccgcacctgctgttccctccgctttgaggtatttcctcctcactcacgtccctctttgtccaggtctcaggaggcctgctcttgtatgtgagtccctagctagatggcaaaccccttggggtcagagacagggactcctggcagcacttgcccttaaaaacttatattcaggcggggggcggtgactcacacttgtaatcccagcactttgggaggcctaggcaggtggatcgcctgaggtcaggagcttgagaccagcctggccaacatggtgaaaccccatctctactaaaaatacaaaaaaaaattagccaggcgtggtggtgggcgcctggaatcccagctactcgggaggccgaggcaggagaatcgcttgaaccccagagggagaggttgcagtgagtcgagatcgtgccactgcactccagcctgggcgacagagcgagactctgtctcgaaaaaaagaaaaagcaaacaaacaaacagcccttacattcagcatagggcttagctaatacatggaagcaactgactactatgtgttcaataagcaaatgaatggtcgtgtgaatggataaatgaggtctgtgaagttgaatgcttgtctgggtgaggggacgtctcctggctcaccctcacctctgttggctgtgctgcaagctgtagtcaggatggtcattttccagctttgaccatgattgctcttgcttttggtgtcagcgcctacctgtatggtgccctccattcgtcagttgccttatatcccagcacgcttcctcaagagctgaagaaacgtcttacattttcatatgaaatcattttcaagcaaggtatagattcacataatacataattaatggtaaaatgctattagcattatgtacttaaattatttggctttaaggccaggcgcggtggctcacgcctgtaatcccagcactttgggaggccgaggcgggtggatcacctgaggtcgggagttggagaccggcctgaccaacatggagaaaccccgtctctactaaaaatacaaaattagctgggtgtggtggcgggcgcctgtaatcccagctactcgggaggctgaggcaggagaattgcttgaacccaggaggtggaggttgcggtgagccgagattgtgccactgcactccagcctgggcaacgagagcaaaactccatctcaaaaaaataataaaaataaaaataaattatttggctataatccccattggagttactgtttaatgggtagagagtttcagtctgagttgatgaaaacgctctggagatggatggtggcaacagttgcacaaaaatgtgaatgtacctaatgccactgagacccacacttcaaaatggttcaaggtacattgcttgagcctaggagtttgagaccaggctgggcgacagagtgagaccttgtctgtaaaagaaaaaaaaaggccgggtgcagtggctcatgcctgtaatcccagcactttgggaggcctaggcaggtggatcacctgaggtcaggagttcaagaccagcctggccaatgtggtgaaaccccgtctctactaaaaatacacaaattagctggacatggtggcgggcacctgtaatcccagctacttgggaggctaaggcaggagactctcctgaactcaggaggcggaggttgcagtgagccaagattgcaccactgcactccagcctgggtgacagagtgcaaaaaaaaaaaaaaaagaaaaagaaaaatatcagtcgggtgtggtggtgcacgtcgtggtcccagatactcaagaggctgctgacgtgggaggattacttgagccccgtagatggaggctgcagtaagccgtgatggtgccactgcactgcagcctgggcaacagatgagagagtaaaaaatggttcaaatggcaaattttatggatacttcgccacaataaaaataaatttctattaaagtacatatcattaattccacaaatgcaaatagaataccaatcaaaggaagtcctcagaacacagactgcacagtaaagtgtgggcctaactagaccacagcctgtttcatgtcaccaggcttagtggatgaccgcactgcaaggaaaattgctgagactgagtcatgttttggttctctggctgcttctattttttttttttttagatggagtttcattcttgttgcccaggatagagtgcagtggtgtgaacctccgcctcccaggttcaagcgattctcctgcctcagcctcccaagtagatgggattacaggcacccgccaccatgcctggctaatttttttgtatttttagtagagatggggcctcaccatgttggccaggttggtcttgaactcctgaccccaggtgatccgcctgcctcggtctcccaaagttctgggattacaggcatgagccaccgcgtccggcccctgggtgcttcttattttggaaaattcttccccaaatgagactaattttggctcagtagaaaaattctctcacctcttgtcccgaaggtgaaaatccacctcaatgattttcaatttttttttaatcatcatcggcctcttttattttttttctgatagaatgtgctttaagagatagttgtagcctgtttcctattcctgcatttataaagtaacaattcatttatccttgccagctgtctgcaagcttaaaatacctagacacatctcaccacccagtagtgtccttgactggcttggatggccagtttccctatactgatttggtacaattgctacattttatagaatacttaaatatgaatacaagtgtgatttctgtggggcttttgacaaaccagaactagttcaaggaccctcacaatcaccttcaagggacaaaaacctgcattttgtgtgtttcctggtgcgtttcctttaagagtcctggcgcctgggctgtccagcccgggtggagggactcccgagacctggtgatggatgctgtagtcaggagtgcatattggatctgttacacggtggtgatatacgatttcaacatttcagggttgatttggattttctgtactccctgcctggaattttcctgctgtgttgttttgtgctttactgttcaacaagaggaaaataaatctagaaacctgcttaaaaatagacatcctgttttcaattctctatcattaaaagatcttaaaagctagaatttagttctcttcccggtagaaggaaggagttgcgctaaggtcccttcttagaaattagctctagaaatcctaaaattctagctaaccaaccacagtgttcacgggcctaatatcccttacatttttcttgtctgacaggcccagagggctcactgtctgtgagctttcacggggttgttgctatcccccagggttgattgatctgtttattctaagcttgaggccagagctggaagggaggccgtttgttttgggcactgctgagaaaaacagactaatcacctaaataccaccttggggaatgaagttacttgaaaagaaactgaatggagcctgggcttttatttggaatgaggaggcaaacctgggaagctgcatgccgctgaatgatgatgaaaagcacaaagctactgaatgcctctggcttggccgccaaagagaattggtttctgtaagtgtcggagagggaagacccgcattccagagctgcacccctttcttcacatttccggtccctctcccccagctcctgcacaccctgatgctggaccaaggggcctgggcagaggtgggtgtgctgggcgggaaagtacgtcatggatgcctcaacttgccatggatggcaggttgacttccttcccagcaacttgcagatgttcagatgcgcagagttaaggtctaaaacaagaaaagtttgctaacgtagagtggccgctgggtcttatctttccgtcttcaatggccttgaaaaatatggggcacgcatggggatttcacactcttaacaagctaatgtctctaacactacaggttacacttcacctgatttccaggttagtgcagcgcctgacctctctccagaggcaccctcgtttagaagcatagatgatgcaaaaacatggtttctcttctcagttcagattgcctctgttgcaaggactgagaactctgaggagatctaggagatccctaagtatattaggttttaattctgggtcaaatcagcaaatgtttattaagtacacacaacagacagggcactgtaagacaaaacaaatcaatcagtcaacgtcaactcttgtcattgcttggggggtaaaggcaatacaaggaatgactggcaaatacaggtgtgaattccacttaccctcagcaagacgagggaagaagaagattctggaaagggagaattctgccagcaccaacctgatcatccttctgggcatggccaaatgcctccatttttcctctgaggggcttctttgccctgaggaatatacaagttgatagggctacttgccttcttgctcattaatatctgcttggctccggatctgcaggtagagcagtgctggaattatcccagagctgtgttgtgacctctggatgctagcctttccaagcagggactttgctgcgactccctaagttcatagggaaagcagcaaggatgagttcgggagactctggcatatgcatcagagttccagagtgaaaggtggctctgaaaactttgcaaactgtacataactcaattccccaggctgctgtgtgtccgtcatccctgaaatttcatgaggccagagtaggtcaacaggggctaatgagacaagatctaactaaacagagtaaagagtttctcggtcacaagggaaacttttactatttgaaatcagcctgagccaagattgatgaggaaaaaaaaacaaaaaccaaaatctactgcattttactcctatttaggaagaagtaaacttttgtaaacaggaagaacacagggatatttgctcttagctagaatggggcaaattggcaacagttttgggtgcctacggctttgggtttgatggagtcaacctgccactaaggaaatagacccaaggaggttaaactcagtagagagctatgggtattcctttcctttaagttacagctcccaggaaagcaaaacacaagctgaacaaacattatacaagccatgtatatgtgtagcatgtgtccagatccaattcacttatttgctcacgcttctaggaactccatccttgtgcttttatctcctgggctctctgactttgagacttttcacagctgtcatcatttagcataaataacagcctgcggaagagtgggtgacaatgtggcattttgctgggccacttcttgctcagcatttgtcgtggagtcttctgccattggccatgtgccaggcctgacaaacagccatcaacacaacttgtcaccaagtgattttgaaaacttattgttgaggtgacttcattcttacatctttcgtgcttggcaaagtaattactacgccaagttttttttttttttaatcaaaataaaacactgattaaatgttttcctgtatctggattacaaactattccgtgatctccaaactttgtcctctcgtgtgtgtgtgcatctcacacaatctctgtccttcttggaaaaatgtctccattaattactggggatgaaagttgattaaaattgtaggtcatttcccagggaggttttatgtgaataactttagtactgtgatgcactacttatgaaatctctggtctctttctaaaatcaggttggagaagaagagactgtgcatgacagtgcagccatgtggcttggagactatgtgagtggaagcattttgaggatacgatttctgagtccatgctatttctctgttgtagcttagctgtggattccttacgtgcgaatgatttgggagtataagaacacagactcagtgtcatcattttgtctaccattaccctttcctttagaaaatctgtttgtgtcattcatttagaatgttgccgttaacaaagtattttatgtatactattttatttggacattatgatggtccacgctgtgaggtcagccagctattgttcatatttgttccagatgagagactggaggttcagagcagcaatgtgccctgcacacctccacacagttcacacagtgctcagaacagcaatgtgccgtgcacaccacacaccctgttcagtgcagaggcagcaggcaggaccccaggacttctgagtcctgatccaaagctacttcctcaaaatccctttactactttattattattattttttaaatagactttttaaaaagcagttttcagcttatagaaaaaaagtgaatgaaaagtacagaattcccatgtgccgcctctcgttctcctcagtttcccctgttattagcatcttgccttagtgtgctacgtttgtttcaactgatgacccaatattgatacgttattgttaactaaagtttatagtttatgttagggttcactctttgtcttgtacattgtatgagttttgacaaatgaataaagacccagtgatcatgatcaagtgtgatttccccaaagtgagatgtgttgtccttcacagagcacacttagtgcagtggcggtcaatctaactggttttttttgttgttgtttttgttttgttttatttatttatttattttggtggcttagtctcctctgtcacccaggctggagtgcaatggtgtgatcttggctcactgcaacctccgcctcccaagttcaagcaattctcctgcctcagccttctgagtagctgggattacagacacacgccaccatgcccggctaatatttgtatttttagtagagatggggtttcattgtatcggtcaggctggtcttgaactcttgatttcaggtgatctccccgcgtcgtcctcccaaagtgctgggattacaggcgtaagccaccgtacctggcctgtgtttttcaaatgtaaacaaaaggccatcaagcagtgacagttcatctcctgacttcatttttattgtcacaaaagtgttctggttagaaagaaaaaaaatcacatatccaccattacagtatcacacagagtcgtttcactaccctaaagccccctgttctctctctattcatccttcccaccatccaccctcatccctggcagccagtggtctttttctgtctgcacagttgtgccttttctagaatgtcagatagttgtaaccatgtactgtgcctttaccaccatgttgagccttgatgtgtttccttcgttggttttatcaataacaacgaacattcactggtttctttccatcgaagttacattttttcatgaaggtaaactcttaaacaagtgtctctttttgtcaccctctcctaggcctattcttgctattggttagaatgtggccaatagattcacctcatggtagcaatgtccttgctgaatataacaaatctgatggttgtcatctaccaagaattttgtttctctgaggaaaatcagcaaaactctcatttcagttctagtgtagcctagccatgctaggctgttttgtaaatgatgactattaggagatatttgtatccattgagatggagaacaccgaagcttcgaaggaggaaacagcttgcccaagtaaagaccattaggagaacacaaaataaccaccaaggcttccttattcccatttgagatgctgctgattgagccgcaattggccagtgctctaaaaccgaggcctggaaaggacaggccatgccagttcgctcagccattcaacccagcagccctgactattgtagccaaggtgatggacttgattcccatagaaagcagcatcaccttggagctcacctttaactcctggaggctggcagggcccctgtggccacaactagactgtgagaggaaccaagaaagtacgttgagatcttggaaccaacccaaatgcccatcaatgatagactggataaagaaaatgtggcacatatacaccatggaatactatgcagccatagaaaagaatgagttcatgttctttgcagggacatggatgaagctggaaaccatcattctcaacaaactaacacaggaacaaaaaaaccaaacaccgcatgttctcgctcataagtaggagttgaacaatgagaacacatggacacagggaggagaacatcacacaccggggcctgtgggggatgggggataaggggagggagagcattaggacaaatacctaatgcatgcggggcttaaaacctagatgacgggttgataggtgcagcaaaccaccatggcacatgtatacctatgtaacaaacctgcatgttctgcacatgtatctgagaacttacagtataataaataaataaataaaaatcacacacaaaaaggaaagtacatttagatctcatctccctctcaccccaaatccaagaacagaacaactcagacacatgtcctacagatcagcacacaatttttttgtgattgaagaaacgaatactaacattggttgatggaagagacagtactctaaagtcagcatgataatggacagaagaacaaatgatgcatctagtaactgatgtttaacaactgattacctgtttgtatggcatatttaaacattattgtgttttctgctgtttgggtagtggttgtttataattattaaagatgccccgagtgacaaagagacgaaggatcatgaacatcttaaaacacttcttgctttttaacaagggcagagcaaagttgttaaaaaggtaaccgagggtcagataaccaatgattcattgatgatgaatgctcattcttctagtgccaatgtggtaaaatgtggatgtttttaaccttgtaagttaggtggcagcatagtctagtagaaaacacctctagctcatggatgaacgtttctccaatttgctcccaagtctcttattgatactatatttgggtgaccctgggcaagtcctattgatagttggctttgacttaggacaaatgaggttacacagactgagagttttgtgttggacttcaagtacgcttctagactaaaagcattatgccattaatatttatgttatatagcttgtatataagtatctctattcctattatcttattaatgttcacatgtatggatgtgtatacacgcatggatttgtgtagatatgtgtggttgtgacgtatgtattttgtgtcttacagttttgcaaagctcttttgcagacattacctcatttgatctttcaacagtctctcagaagggggatgtccttgctttcattttataaatgtggttgagagaggttatggttcctgaaacttgatacaattaccaagtttctgaaatataggaaaaataacttcattgtagacaaaggtcacaatttcaagaggctttgtaacgaaattatgaacaagtttggaaaaactgcaagaaattcattgaacaaaattaagaagatcagccttttgagaaaggtctctcttgatggcaagaccgagcagcatctttcactgagccacagatttgtatggcggattggatttctggggaaggttctcctcagaacagtgcccttcagtccaccggaaagtgccactccaatttttagttaagaaaggctctgaaaagacccactctcaaaggtaccacctgttcatgtagtcattaatttgttaactaattaatcgacccatctatttattcgcttattcactcaaaagcatttaccaagctcctactgtgtgtcctcaaggacatccagctgtacgggaataaacaggggaagcatatggtggacttgaaggtggagttggtgtggaccctgccgtgggtggatggaggtggaggtggggtggtcctgccatgggtggatggaggtggaggtggggtagacccttatgtgggtggtgggaggtggaggtggggtgggccctgccatgggtggtgagaggtagagttggtgtggactctgccaggggtggttggaggtggaggtggggtggaccctgatgtgggtggttggaggtggaggtggggtgggccctgccatgggtggtgagaggtagagttggtgtggactctgccaggggtggttggaggtggaggtggggtggaccctgatgtgggtgattggaggtggaggtggggtgggctctgccatgcatggttggaggtggagttgatgtgggttctgcacagcttaggctgagcaggaagtgtattttcagacctggaatagactccctatggtggacagagttgctggaaaaaatatcagaatatattgtttaggacatctcatcttcaagacatagattccccttcttatggaattttgagatgtcctagctggaggaagaagaattctttccatggaaacaataaacagtcaaaatgtttactatgaaattcatggaaatgctctgccagaggctcgggaatctctgcagagaacattttctgtactgcaggatgacagaggctgtcgagaataaaatgaagctgagtgcttgtggttgggattccttctttttcctcttttattgtttctccttagctttgtgcccaggtcatttgtctatcttccttcccttgaaatccctcctgctttggggccctgcactgcctctggagcatccagttctgagattccaatcacagggccaggcatgaaacacggccatccctcaggcacacggctgctgggatatggcaagcttgttaacacggcaggacaacccaagatgccatgttcctaaagaaaatgggggccgggcacggtggctcatgcctgtaatcccagcactctgggaggtcgaggtgggcggattacctgaggtcaggagttcgagaccagcctggccaacatggtgaaatcccgtctctacttaaaatacaaaaattagccaggtgtggtggcatgcacctgtaatcccacctactcaggaggctgaggcaggagaatcgcttgaacccaggaggcggagcttgcagtgagtcaagatcacgccactgcactccagcctggacgacaaagccagaccttgtctcaaaaaaaaaaaaaaaaagaaaaaaagaaaaaagaaagaaaatgatattcattgcccacctccttacacacatacccagagtggagttaatcctttccatatctgtgtacccatgcttctttatatatattaagttgaaccatatgaaattgccaggattcacgatcttgacctgcaaaaataggcagtttcatgtagttgcacctgctatgtgtggcatttgttctcactttcaccgtgagcgtcatttgttgactttagcttaaaaccaaccttattccactgcatgccaccttgtcctcagagaattcataaagacaggcttaagaatccatttcagctgggcgcggtggctcacgccagtaatcccagcactttggaaagccgaggcaggcagatcacctgaggtctgagttcgagaccagcctgaccaacatggtgaaaccccgtctctactacaagtacaaaattagcgggcgtggtggtgcatgcctgtaatcccagctactcaggaggctgaggcaggagaatcgcttgaacccaggaggcagaggttgcggtgagccaagatcgcatcgttgcactccagcctgggcaacaagagtgagactccatttaaaaaaaaaaggaaaaaaaaagaatccatttcatccagccttctgattctaggaataggaacgtcaattcaatccaatgaatcctgggacagcatttggtgtgccaggtagagcgtgtgtggcggagggggggtggtattgtttgtgacgtaggttttctgattggaactactgttgcaggcttgaccatcacctcccactactgcgtgtgaggctaaatgctgctccctcgcttattgctaaatggagagaatacgagggagacaatggggaacgtgaaagcaacaacattgtcaactggatttgatgcagggcagtgggcagggactcagaactccactccccctactcagacgggcaatcatgtcacagtcaagatgagaaatacccatcgagatttgagtgcatgtgactcttctaaaagtaaggcgtgttcttcacagcgcacactgagcaccgttgcagtcaatctaactgatgtttttcaaatgtaaaccaaaggcctcaagcagccacagtttatctcctgacttcctttttattgtcacaaggtgttctgtttagaaagaaaacaagccgttagaatattccaacagaaacagcattaacatgatttactaggtgggttatttagggttactcagccaagaaatggcatttctggacagtggtagatttgttcagcctctcacaaattgagggaagtggctttatttcttcccacccagctagttcccctgtcctcagcccagagattcaaatgccaacggctgccaagtttaccccaggaccgccaggcaaaggttccggaccactgtttgttttccatttctgtggcctcatcatgctcagaaatgctgacttctacgaagagcccagaaaagttcagatgtgtgccaaggctttggttgtaggcttggcacaaggagcagcagctggtaaggaccaggagacagcccggcctcctccatggtgcctgcctctcatagaagcagtcaggaggacaagcttttggtttccgcagacttagcagtcattcctgtgttcctaagaatcatactcgggattttaaaaattcatgtatttagttataactgtgaaatatcatagaaccgggaggtgatgtccaagtcatctggccagtccagtttctccttttgcacatcaaggatcaggccccaagaggccaagggattagtgggaacccttcttcttgccttcacatccatctctcagtctttgtttcctatcgcttacagttgtttttcacttctctcttcttttcctactccttaccatctgaagaactgaaaaaattattccaggttcagcaatgttggaaccaagttttgtaaacggacctaagccttttacaatctgggggaccttctttaggaaatggaacacagatgaccatgtatacatgttgctggcgcccctcctatggctttggaaggcacccaggcaggtgaggagccctgaatctcgagcttcctttagctttacagtgattcagtctctggttaggaccattacgatttctttctttatttcccccttacttatgccctatatgaaatgaaacagatgtgagtgtttgaatcaaaaagacttccctgatgtagtggtctcattttagatgctcagagcatagaataagtggcagcagaccttacttgttccatctggtttttgcatagactgctcgagttgtttttcctttctcatttgttttcctcccttgcattttggtctgtctgctccccaaacttttagctatgaaacatctctagaattcgacatctgtcagaggaggcagcggaagttctttctctgggatccatgagtcctgactcccctgatactgtgtgctgagagagggttttgttttcataattatgacaattcccatgtattgaatgcttcctacatgccagatatttccagagctctgtgtccctggaagagtcaagaaccactgtttatagcattgagaaggaaagagtctagcctctgacatcttttcttctaaaatgactgcaacacatggacatatttttagctattttttccatgaaatgtattttctaatgacttaagacattagatcaatgggaaaagagagcgtttatgtttttatgaaggtaatattttcagtggcaaaatgagctttatcagacctcaggaacttgtgacttccagaaaacaagaatggttctgacctgggatcgtgagaatgtctttatcctagacatgccaatccacacttagccagtgtgaagggaagagtctgcacttagccagcatgaagggaagagtggcagagaggggactatctgagtcctgtcacggcctgtcaggagagtgacaggtgagggtgggcaggaggtctccgaatgaactgctttgctggtaggctgtgtttctgtgtttagctgaggagagggcgggagagagacccaggctgggaggtgggggtgcctgagcctcctgtgccatttggagcatgtcattatgggggagtcacttattttgcaggggggaggggggtcccaggcctaacatttgtaaaattagggaatatgctgggactaagggttcgttgtggcctgcagtctgtttctatttatttattcatactcataaacatagatctctaatataggccaagattttgaaagaattagtagttgcaatttcaccttgtaagactttctcttttaggtaccttatattagttttacttgttagttacccagatatgtcaagcatagagctaaactgaatgcctgtgtatttgctgtaagcattgcctgccttaattcatgctgtgatgtggtgtggtttgcggaattcctagagtggccagtgcaccatgaccaccaactgacactaggctccttctagcaaagaccagggaatgtggtgatgcctttagttggtttataaaggactagcacccatgagcaggaaagggcacgacactcattttggcactgtgaccgccctcctggtcacaacgcctggtctccacactggcagggctgttcttttacaaggagggacacagggtttgagacaggtccagttgtcgctcatcgagaactcgtgaagacagacaggggagcagtgaccctggaaatcagctgggagagtccattcatccacgtagtgagaccgtgtctctgttgcggttcttatgtccacccacattctgtgattcattgtgtgttcttattagtatattataatctattagagggtatttttctctaattttctgtcattttgtagttctgtgcaaaaggcatgaaattgtggattaaaatgagggcatctggatattgctagaaaacaccagctgaattcacaggctcgcaaagaggtcgtatgtttggaaagctttagccattgctgtggttttctattttctggaggtggggacaggataggaggtggaccctagtccctagagactatttccaaagtgtgtttcccagttgggatcaattattgtttgttgacttggtctcaggattgggctgcgttctaactcgagaattgccaggcctcagggaagtgtctgcttttcagggaagtccgcccatcatctgccactaacacaagtcagagggccacggccatcaccagtgctgcaagtgggaagggcagagtggacttacataaacaccgtggcattcctgcctgcagctccggagctccaccctcatcgccactatctctccttggacttgaaccacaggcagatgaggccccaggaattagttgcacctgagagtctggaagtatagcccaaccctccatgtgtggaaggacagggtccagacccctcccgtcctgcttctgcagtggctgaatggctggaggccgccatgacacccctcatacacattcactcactcaccattcactcccactctcctgcccctgcccctttccaggctcccaactctctctctcatgtgtaccttgaaggtttgctagatgatatcatagtagacgctaacgaaatcgttgttaaataaacaatagagtgacatgtatacaatcaataagaccaaaaaaggtgtttaaaaaaatcttttatttttattttttaagagacaggcctcactccgttgtacaggctggagtgcagtggcacaatcactgttcactgcagccttgaactcctaggctcaaattatcctcctcccttagcctcccaagtagctgtgactacagctaccgtgtctggctaattgtgaaattttttggtaaagacagggtcttgctatgttgcccaggctgatcttgaacctctgggctcaaccgatctgaagtgcaaagattacaggagtgagccactgtgcctggcccccaaaaaggattttaatgttaggagctgagttatctgagcagacacagtccactgtctggtcccaaggctccatgtagaattgtctgcttttagcacacaggcccacctgggctggcctgaggaggaaattcaggagtgggagatgccatcttttcctagccaggaggggctgcagagcgtgtgggctgagactcttggggagggggtgtgaggggcagtcacatggcctcatgtgaaattctccataaagaatcccaggcagaaggccatggacaggcaggctggtgcaccgcatgtgtgaagatgagcagcagggacaacgggtgggtggggggagggagtgggggagggagcgggaggactagagggagtgggaggactagggaaagtggaagagggagtggggggagagtggggaaagagtgggggagggagtggggacggagtggggggactgggggaagtgggagagggagtggagggagagtgggggagggagtggagggagagtgggggagggaggagggagggagtgggggagggagagtgggggagggagtaggggggtaatagggggacagtcgggggagagtcggggagggagtgggggaggaaataggggggtaatgggggaagagccgggggagagtcggggagggagtgggggagggagtggtggagggattgggggagggaatagcggggtaatggggggagagtcgggggagagtcggggagggagtgggggtgtcggaggatgtctgatatattcactccttcctttaatgatttcaaatgaagtgctttttttaaaaggcaggctcaccaatgaggtgcgggaagtccccgcagagagagagcccacgtagtaagtaaggaacgggggcggttagagattctggagaggccggatggaaaatgcacacacggtgagcagaaaccatgatcctgagacgctgatgtccaggagggagcctcagagcaggaacgcagccgcggcagggggcggtgggagtctgcggtatgacgtagggtacgaagggcctgggggtggcagagcagagcctgctgcggaggcacaggcttctcattccgcgcgagtgaccgagacatggatcgcgctcttgccggaggagggtgcacgtgcggaccagaggcttcccagcgccacggtgccaagttgtgggggtgctgagccaggagcttcagaagagcctcacaagcagggcacaagctgagaaaaatgacagctcacgacactctttcttcatatttaaaccagaggaccaaacaactcaaggtgctcttaagaaaagcccgcagtcgtccaagactttaaatgaaaacgcggatctgaaaatgggtgaaggaaatttgaggtacccacatttgccagaacatcgcgtccaccctgaagtaaggtgctacctgtggtggacacctttgtgacacttcgtctctaagtgagataggatttccagggagcgtgggactgtccctggattggtggctgctgaggaaggatttattttccatggagctctagttggctgtgagattttaggtcaacaactggctacagatgatagatggagagatagcccctgtacaatattcactgtggactattattatatagtgcatagtaataagacaatgtacaaaatgtgatagcgtacacttctttcgtatgtagaaaatgcagggatttttaaaaagtgagatttactttggtctgaagtcctcatcaggaggccaggcgtggtggctcaggcctgtaatcccagcactttgggaggcgaggtgggcagatcacttgaggtcaggagttcgagactagcctggccaacatggcaaaaccccatctctactataaatacaaaaatcagccgggcgtggtggtgggtgcctgtagtctcagctagtcgggaggctgaggcaggagaatcacttgaatgcaggaaatagagattgcagtgagccaagatggcaccactgcattccagctggggcgacagaacaagactctgtctcgaaataaataaatagcaataaaaaatgaagtcctcatcaggaaatgcagtaagcagatggttatgaactggattacgctgctgcagaccgtcttctaagaccatttgtgtatcagtggttggaggagtgtgtaggccaacctctctttgaactgttgtaaattcattcaggcagatgactaaaaatgacataacccccacccgtctcccaagggggcaggtgagaggtgggtatagcatttcaggtcagaatgggggttctcacaattcatcagtgttcgctccccaaatctggatttacagtctgaaatgttctttctttagcctctgaatgccagaagtaagcacttccttttaatttttatttttccctagcaaattctttagtgagcaagcttttgtctgatctaacctttctctcccctgttggtttcagcctccacctttgtcttgcctttccccccaccacttactcccacccccactgctgacatgttgtgagtcgtctcctggaagccacagccctgctggttttcactcagggtggtgggtcccttatgtgtgtcatgctttgcacaagacagcgaggagtgctggctggtttgctggcgcccagcactatgacctggcttccgttcatggctcataagtttccagtctttggggtatctgtggcttttatgtcatctcactgcctctcctcggcacagggactggctttgctgtcgatggcagacttaaggcaagtgcagaagggaagaggactgctcagaaacatctcctggagacactgtattttcaatgggtctctccaaatccagcagaaaaagggcaaaatgtagggaaggggtgccaacatgaagccatcatggtggtgccaaggatttattgggcagcaagaatcaaaggactggtgggaaagaagaaatcagagtcagcatgcaggagaaaagcagaacggagacagtgtggctggattgatagaatactggaaggcccaacagatagtcccacacccatgttcacagcacattagccacgattagccaaaagagggaagcaacaccagggcctgtcaccgtataaatggataaacgagatgtggtctctacatacaatagaatgttgtttcagccgtaaaaaggaatgaaattcggacacacgctacagcctggatgaaccttgaagacatgatgttaagtcgaatcagccacagtcacaaaagcgcaaatactgtgtgacgccacttaggtgaggcacctagagcagtgaaattcatagagacaaaccagacgaagtagagtggtggtttccaggggctggcgggagaatgggcagtgagtgtttagtgggtgcggagtttcagtttgggaagatgcagagcgttctggaggtgggcggtggtgacggttacacagtcatgtgaatgtacttaatgccatggaactgtacacttaaaaatgattaaaatggtaaatttatgttacatttttacacacacgtgtgtgtgcacatgcttgtaactctccattttttatcttttgatcctaaccttgaacctctccagagccttaacttaaatatctcctcaggccgggtgtggtggctcatacctgtaatcccagcacttcgggaggccgatgccagcggatcacttggggtcaggagtttgagaccagcctggccaacatgctgaaaccccatctctactaaaaatacaaaaattagccaggcatggtggtgggcgcctgtaatgccagctactcgggaggctgaggcacgagaattgcttgaacttgggaggcggaggttgcagtgagctgagatccgcaccactgcactccagcctgggcgacggagtgagactccgtgtcaaaaaaaaaaaaatctcctctacgagtggatgtcgggtgaggtgggctggggtgggcgatttatttggggcttagaaggaagcagaaaagttcagtcatcttctgttacccatacagcaaggtacaagaaacaatgtgtgtgggagcagcaatggcctctctctctttttatttttcagaggaagtggtggtaattccttttagtgtcttgcattctacatgcagctttaaaatctacactgacatgtttcaagcaatctcataggtggctactaacttaatttgtgttttgctcattcctaatgcgcaggaatgttatgaaaatgttcgttcctggtgttaactaactctgttcagtccttgtatcctggttgattaatggcaaggtaattgcccttcatttctttgccttcaaagcagtgccacctaggtctttactgccctcaaaacagatgtcttctgcaaagagtgaaattccgatcagtcagtccctcctcataaaacatgtaggtgagaggccacttggatgcacaggaaggttgcaaagccagctgccctgcaggagccttcagaagagtgacctccatctggggtcagaccccggctccctggagggtcagcagaggagaaggggcatcttctggagaggagtatgggtgcggggcagacaaaggaacagaaacagaaacaatcaagaatgaggagtgagcctgcagtgcaccttagagtgtgtgtctattttctgccaagggtgagatgttctgagcattttctctatgtctacctccgtcaagtactttccataactgctgtcatgtcagcctcctactaaccctgtacagtaggtatgactgccgttccattttcatagatgagaccgaagggtaaagagggtagataactggaccgagtctacacatgtattaggtgtcggagttgggatttgaacccaggtctcatgaccttaagttgggcgagaactggatgtaatctggagtggccagcatgttccgctggggctgtgatttcagttatctgtaagaaagcatgaggcagctaaaaccactgaggcccagcaccagtgcagcatctctgatttccttttgccctgcttgtgtctggggacttcagactgtctgtctgctctctggattctgtggtccaactggcacttctgtgctaaaaatgaaggcataattgaggcatcacggaccccagatgggccctgcagcctggggcaaggctcagctgacctcatggcacccgtctcagtctaatccagtcttggattgccacttcccctttttggctttgccttgtcctcccctggcctggcatcccaggctcctgcttgtggtttacctgtgtgacacacacagacacatatacgcactctagtgccaaacatgacagaccaggaggttggttttcttagcctgagaatctgcatcatctgaatgaggtagaatctggaggagtctggactgtgagggaggaagcttgggaaggagtcaggatgggatgtgctgcccatcaacgcctgcagggaaagaagagtcccacgcagggaaaggagagtcccacgcgggaaaaggagagtgccacgcggggaaaggagagtcccacgaggggaaaggagagtcccacgaggggaaaggggggtcccacgcggggaaagaagggtcccacgcggggaaagaagggtcccacgtggggaaagaagagtcccacgaggggaaaggagggtcccacgcagggagagtcccacgcagggaaaggagagtcccacgcagggaaaggaaggtcccacgcagggaaagaagagccccacgcggagaaggaggagtcccacgaagggaaaggagggtcccacgaagggaaaggagggtcccacgcagggaaagaagagtcccacgcggggagagccccatgcagggaaagagggtcccacgcagggaaaggagagtcccacgcagggaaaggagggtcccacgcagggaaaggagagtcccacgcagggagagtcccacgcagggaaaggagggtcccacgcagggaaaggagagtcccacgcagggaaaggagggtcccacgcagggaaaggagggtcccacgcagggaaagaagagtcccacgcagggagagtcccatgcagggaaagaaggtcccacgcagggaaaggagagtcccacgcagggattgctgttccactctgcatagccgctgggctttctgctgcacggatgccatctagaagaagcaccatccactgttctcagaaagaagagagaggaaggagacaggagtgcgtagagtgagtgggccatcagaaaaaggactgctctggggatgcaggagacccgcttgtaggatttaggggcaccgtgcaagacaggggtcatggtatgcgggtgcctccgactggcggctgcgtggtggatctggccacttggtgaaggtcgcagtgaccttgatctgctctggggagggatgctgttttgcctttcttcacgcacgtggaatcaggactagctggactggcaggaaaaggttctctctggaataatggtttgcttctctgcaggctcgtgcggcggctcgtgcggagccctgtgagcactcattcttgggagagcacctgaagccgcctccaggtttagtcatttcctgctttttcctatacataccttccgtatcaacatgctttttgaccttcctcacctgaatacatctgataccctatgaattcttacctttctttttccaaagtggccaggaactgaaaatgcaacttcattaaactggaaagactggctctttgctaattagtccatttgaaatgaaactaggctaggatttttggttcacctcccagatcacaggaatgtattgcctcattaacagttgaagaagcagttttaaatgatccaagaacaagctgaccacttggattcctgggtagtcggctgggcctcctgtctttctgcaggtttgtgacttacctttgcttccatgggaagaaaggaggcgggaaatgaggtacaaagagaaaattggagtgagtgggcattttggtttatcaagtagaagcaattctgtgtgtatgtttgggaggatgtggagagcatttagaagttttatttatttatttatttatttatttatttatttatttatctatttatttatttttgagaaagtcttgccctgtcacccaggctggagtacagtagtgtgatctcggctcactgcaacctctacctcctgggttcaagtgatcctcctgcttcagcctcccaagtagctgggattacaggcacccccaaccatacctggctaatttttgtattttaagtaggggtggcgggggtcgggggttcaccacattggccaggctggtctcgaactcctgacttcaagtgatccatccacctcggcctcccaaagtgctgggattacatgtgtgagccaccacgcctggccattcatttagcctggtgacctagaagtacttaggaaatgtgtgtgtgtgtgtgtgtgtgtgtgtgtgtgtgtgtgcacccgtgtatgagtatatgtgttttggttttccaatctttggttcacgaatgtagtccatattcttagaactgactcacatataggaattcaataaatatttattgaattaataaataaatgactatggtgtgtgtgtttataggtgcacacacaaacacacacacagagtaacatctcacccataagtcatttatcgagcaaccataagtatttaaaataaatgacaaattagaaagtccagaagaccatgcagtggctgcataaaggtgacaaagctcatgcttgtgtttctttaaaagaaacttatcacccttcgcagccaggtctcctttagatagcgtgcttggccgggagcagatcagaaatggcaaactaaagataaagacaatcacaaaggcaaaaccaacaaagcgacagctaacagcttgacaggaagagaggggacagaaagcagacacagagtctctaagcacagccgtctggtttggggcaaacaactttttgcactttaccgtgcctgtggaaactatgtcatgcggcatggaatgaaattaattaacattcgtagtagacgctgaatcatcaaaagcttgaattatatctcataactttgtaggaagatgaagttactctagcaagattccttcaaaatggtttacttgtttcttaaagagtacaggcttccattatgtacaccaggaggcagaaaactgtggtcagcagaccaaagccagcctgctgcttgtttttgtaaataaagttttattggaaacaaccatgctcattcatttacgtgtttctgatggcaacttcctccttcccctcagcagaactgagtagttgagacagaaaccatatggcctgcagagccaaaaatacttaatggttatttatagcagaagtttgccagtccccaatccagatgttgggttcctcttgaatgttggtttgtgcttatgtatacatctgattcacttgcacgcattaccaagtgatccatatacacgagtgtgaacacatacgcatttctgtgtggtagtaagcacaactaagtgtgagcaccacattctcagacatagctctagaagagagtttctaagaaattagctctgagtcttttctgcttcagtcagctgatggcatggagcagtatgttgtaacctctgacccgaagggcaaaggccttctggaggaagtgtacacccctcagaagcctccctgtacattcaccatccccaaaatagctccttgagtagaggtgcatcgatcacccccaaagcttacataagatcctagcagtcagaaggattcagtgattaggtatcccagactacatagggtcttgtgggatatttcattggtactagaagttgactgcaatggcaagaaaggtatgcttcatagggtagaattttgcttttagggttttttttttttttgagacgtaatctcgctctgtccaggttggagtgcagtagtgctatctcggctcactgccacctccgtgtcctgggttcaagtgattctcctgcctcagcctcctgagtagctaggattacaggcctgtgccaccacgcctggctaatttttttgtatttttagtagagacggggtttcaccatgttggtcaggctggtctcgagctccttacctcgtgatccacctgcctcagcctcccaaagtgctggaattacaggcatgagccaccgcacccggccttttaggctattcttgtggcctttgtcactgacttaatggataaagtttcttctgctaaggcggccatgttggtttattattctgtacggatgtggctgataccacattagtgtgagctttcactagtgctcactttgatagcctccttgcacagcctagctaatatatgtcactggactccattaattttatagtgtcagtagcccagaactcattaaggaagacaagtttctgagattgtagattcctatgggtaaaatatgtatattatcataaaataggtactaaaacgtgatttggatttgggatgtggaagtaagtgccattttattattgagatattcatataccataaaattgacgttttaaagtaatttttagtatagtcacaaaatcatgaatatatattttcaccttgttttaaatataagaagattggttcattttgaagaattctgtgtgacccatatcaaagtagctgttgcagttgtgtagagattcacacatgtatgctctgtcaagatttaccagttggcatgtgtgccataggatttactgagtgtggattatgacagtcctaggtcccttgattttattttatatacatatcaaattgctcttccccattgggccgtgttggagaacaccagggcccagggcccaagcctctagcctaccccaggcccaggggtttgaacaacctccctaccttctggaaacccatttccccccaatactggctggaaggtatgaggagtcgtctttcttactgtccttatcactacaggaaacagggaaagcataagaaaaatgacaaaatgttccagctgagctagagtctcattggagggtacaattgtctctgagtatcagtggaagagtgcctccaggactcctacagaaactaaaatccacaaatgctcaagtccctggtataaaatgtcatggtatttgcgtataacccaggtacgtcctccggtatatctgaaatgatgcctagattacctataatacctaatacaatataaatgctatataaatagttgttattctgtattgtttgaggaataatgacaaggaaaaaaactctgtacgtgttaagtacagacgcaaccatccttttttttttttctgaatacttttaatccatggttgtttgaatccataaatgtggaacccacggatacagatggctgagtatgtactaacatataaatagggctagccttgcttttctgcagcccctgtccctaacatcttattctaagtggccctgggcaaagtgaccattcatttattcactcattcatttgtaggccctactgagagcctacgatgtatacggcaccatgtaccaggccctgagaacacagaggtaagatagacagggtcctgctttcatcgggtttatattccaatgaagataagaggcattcaacaactctttatctaatgagttgtacagcaacccttgtgatatgtgcacttaaagaaatgtgcaggggttttggatagaaaggctcaatgtggagacagacttggtctggaggcggggcagcttctctgagggtgcgacgtttcagccacgatctaagggagggaacagggaaatgcactgcggtcatccaggtgagaaatgatggtggcctcagtgcccaaagtggggacgtcagtggatgcagacagtggatttgagacgtatttaggagatggaattgactagcatcattttattgacacttttcatttctacagtttgagtccatcctcccatcctcctttcccaatcccagtgcctcagatgttctcgtttttcccttggggtgagtctatactgaagccagatggtttcactcaaacccattcagtgctccagagtcaagtgctggtcatcgcaggggagctccggagctgcgtctgtaatgttagtgaccctgatttctaaagggaagtcttcttcagtctgtttctgagattattcctgggagctttaactggaaaagccaagggcttaaaaagatgcagtttttttttttttttttttttttttttttttttttgagacactgtcttgctttgtcacccaggctagcctgcagtggcacagtatggctcaccacagcctcaacctcccagattccagagatcctcccatttcagcctccagagtagctgtggctacaggcacacaccaccactctcagctaattttttaaaaatttttgtagagacaagatctcactaggttgcccgggctggtctcaaactcctgggctcaagtgatcctccccccttggcgtcccaaagtgctgggattccaggagtgagccactgggcccagcacggtgcagtcttcagagaaggtgaactctctgggcacctagagaaacttgtagggaaacaaaagcttgtttataaacttggttcaacacaggagactatgttctccacattgaaaagttccttcatcttttttaaagcatctaaatgatctgtgtctcacttcctaagcaggctggtgggcagggagggtcaccagttggggcagagctcagagggaggtgcacagctgtgcagtgtctaagctcctgcgtctcctgtcacttggttcccgtggcaccatctacgcccatctccctcccccttaagggttagcatgacattgtatcacagggatgttgattttcttttcacttcagttctggattttcaaattctcagaccacataccaagttgaaagcaatcctttgtttcctcttgaaccgtaaaccagaaattgtgcttgggaaaccataccaggtgactaactggaaaacatccccaaaccttgttagtctttggccgtagacatttaattctgagccctggatggatggtgatattaaatacagattgtgcgcacattagtagtagaatgtacccctgaccaatttttcacacatttaaccaagtaaatggcttcttgccttcagtgagtttttatttcaagaccagcaaccattgcaccaagatgaagaagtgagccgcgtggttttctccatccaggggtgcagaaagaaaagtgcagagacagtcttcagtgtttttatataaattcacttttgcaaaaagtatgttgctgtgtaattaagagtgttaatgatgctgcctaaagcatctagggagagcagtctggacaaggagagaatgggaccgtcacccaccggtggctcctccgtctatggcctctagtcattttgctccctacctttcttctgaagtcaattctggtttttgtttttgtttttgttttttccctatttttcccaaagacccggggctggaggcctgtaaagggaccatgctacaatttctgagcaatccagtctggtttaccagaattagaactcagtactgcagaaccctgggaggtgatgatgcaggtcaatgaggccttggcaagaagaaggggagggagggaggatggagacgtcaacctgacataggatttggagaagagtcagagattaagaatttagattaatgtgccaggcgccgtggctcatgcctgtaatcccaacactttgggaggctaaggtggcagatcgcctgaggtcaggagttcaagaccagcctggccaacatggtgaaaccccgtctctgctaaaaatacaaaaattagccgagtgtggtggtgggcgcctgtaattccagctacttgggaggctgaggcaggagaattgctttaagctgggaggcggagcttgcagtgagccgagatcacaccactgcactccagcctgggcaacagagcgagactccatctcaaaaaaaaaaaaaaagaatttagattagtgtttattttggaaagggagagccataaatatatatttcaggtgtctgtcttcactataagtttgtttatggttgaatttgataaatgacttcctttggtctgtggagtgtattagttatttgggtgtgatgtgttggaagaagatagttaatgcatttacaggaggatcatgtgagatttcagatcagggccacctcatgcctttaatacataaaaaccatttaaaacattaaaaagttccatgcaatcttttttttttttcctaccacaatttatgtctttatgaggaatatctccattctgcctctgctctgccagggtaattattatcctgtatacactcaggtctgtgttcaaatcagcataacgaaggctgctatgaaaatgaatatagaattttcataaagttcatgctaaattcttaaactttagcttttacatttttggcagtaggttataggtaggagtcatctttgtaattgacatttaaacgcaatttttcttctcataattgataacgacttcattcgtgccagccgcaaaacccagtgtattattcttgtcagtgcttgacggttttgacaggccagaaaaattgcaagtaaaatagatatatttgggcgtgagatgttgacttataattcatgaagctgcaaccttccacctgtaaaggagaagaattggcagaggtatggttttgatttatgtgttgaaagacagaaaacaaataagaaaacctttgttctgctgtcacaactgatgaaggtaacagtgttaaaaaataatgaaattcacaatacttcctacacatccagtcctctgtagctgcaattcgggggggccaagggcttccttagcagaatctctgggctttcttggggtgcaggtagggctctggccttgctatgctttaactagaactactgtgattttttttccttccttccctccttcctccctgcctcgctgcctccctccctccctcttttctttctttccttctcttttttcctttctttctctccctgtttctctgtctctccttccccctccctgtctccctccctatctctttctttccttttcttttttctctccctgtttctctgtctctcctcccttcctccctctctcctttctttatttttcttccatctcttaatttcattcattcattagccttctgtgtaagattttgtttggaaaaaaaagagtcatatccccctttaaaaacagttcatagaaatgtatcctctagtagtcccagctgctcgggaggctgaggcaggagagtggcgtgaacccggagggcggagcctgcagtgagccgagatcgcgccactgcactccagcctgggtgactgagctagactccgtctcaaaaaaaaaaaaaaaaaaaaaaaaaaaggaaatgtatcctgtacatgaatgtggataatgagctttcctggctggaaaagggcaatcactctggcttctgggatgaccctggagtccttctctgcttcagtaattgccacactcctgggctccgccacttctctattgcccagttcttctgctgggatgctggccttccgccaggcagccttaggttctgcttagacgcacagataatctttaccagtgtgtgagaagcctgaggatacagacagactgcataccgcggccatgtgttgtgtgagtggtatcaggctggacgtatcccttgacaacttgactttttagctcacagttacatttttcggactgatctacgttgattcgtggaaaaacaggtgataccgcttctttccttctatcccccggcttcagttgagttcattctataccccacccgatgcctccgcgtacacactgtagctaattctgcaggagatggagggttccatggtatcttcacacgtggagatggcactacattcgtattctgagctattccccagcagcaagggtaaattttcttctcttgcattctctcgctcagtcaaccttgtgaccattgactcatatttgaatgtcatgtttgggccataggcgcaagtgaggagatgctcacgctggttaccttgcaggtgttttctataatgaagagcccacaagccctcaccccacccctgccctacccgcagctggagtgaaggtggcgccccagaggccactcctgggagaaacctcatcccctccctccttctgcgacttcacagcctcacacacagttgtctgggaaacatcagatctaaccacctcgagccttgcgtctctgtttatgcctctcccaacaggaagctgagactcggaaaatcctcgtccccctccgcacctctctcctactcaccacgcctttccacgggaacacacagcacgttatcagcaaaattccccacaccctcagcgcctttcctgagaggtcctcgtgatggtgtggatctgtgtccctgcccacatctcatgttcagttgtgatcccagcgtgggaggtggggcctggtgggaggtggctggatctcgggggtggtttctcacgaatggctaagcaccgttccccttgctgctgttctcgtgatagtgagtgagttctcgtgagatctggttgtttacaagtgtgtggcgcctccttccttgctctttcttgctcctgctttcacggtgtaaactgcctgctcccactttgccttctgccgcgattggaagctgcctgaggcctccccagaagcagatgccaccatgcttcctggacagcctgtagaaccgtgcgccagtgaaacctctcttcttgtaaattccccagtctcaggtatttctttttctttctttctttctttttttttttttttgagacagagttttaccctgtttcccaggctgaagtgcagtggcatgatctcggctcactgcaacttctgccccctgggttcaagcgattctcctgcctcagcctcccgagtagccgggattacaggcacctgccaccacacctggctaatttttttttgtgtgtgtgtatttttagtagagtcagggtttcaccatcttggccaggctggtcttgaactcctgacctcgtgatccacctgcctcggcctcccaaagtgctgggataacaggcgtgagccaccgcacctggccctcaggtatttttttatagcaatgcaagaacagactaatacagtccctttaccttatcttcctaactgctccccgaagtcctctcaagccacatctgctttgtccccacaccctgaaccaccacgtttggtgctagcgcctcatcactgctccatgatcatccttccctcctcctggagacccctggctttgcatctctggccaccagatcattgttgcagtcatctattcatctctgatccatgccaccttgttccttgtggattgacgctcctggagtgctatcagtacaccaaccctacttgtcagacagtaacacctgtgatttcagtgttcttgtagacaatccttcggtactctggcttctcaggtccttaatctcctcttctccgatgaccttgttcttcactcaacctcagccccccatttccgtaactataccctagagcttattaccggttgtaaagactgataatgcagtcattatctgttatgctccagctccatcatctcatttcaagcatcccattctctgatcaccacctctttcttctctcctaaaaccttgactgaaaacaattcttccacctcactgaagtgcaaaatccatccatcctatcatcttttccccctttctcacctacctcatgtcttcatgtctctcattgtctagtttggagtccttgattatctaatcattaccttgctttactatcttataacattaacttctttacccatctctctcttcatcccactctccttgcaaaactacagccttggtaaaatccagttgcccatgtcctctgtacctgtctgtgcccagctgagcctgggtggaacagaacacagccgtggtgactgtttccagtttatgaccattaacttctagtgggctcgagcaccctctggcagagcgttctcctctttctgtatcatcatttcttctctcttgattgaatcactccttttagcatacaaaaatgctattataactcccaacttaaaaaataaatttctcttaacctcacacatctcattaactactgtcccctttcttttctttctttctttctttctttttttttagagacagggtcttacctgtcacccaggctggagcgtagtggcgtaaccacagctcactgtagccctgtagccttgaactcctgggctcaagtcatcctccttcatcagcctccaaagtagctggtattacaggtgcatgctaccatacccggctaatttttaaattttttttgagagatggggtcttgctacattttccaggctggtcttgaactcccgggctcaagcaatcctcctgtctccccctaaacggatagcaggcgtgagccactgcacttggcctgttccatttctttgattatctttgcagcaaatttatttttaaaatgcgtgtttatactctctgtttccagtttctcatctctatcctctcttgaacccactccatttatcttttagctgccaccactcaatcaaaagctcttatgaaggtcactgatgataatcaagactaaataacatttgtaatagataataattgtaatctgatcattataacacgttcattcattctacaaatatttgttgactggcacctactatgtgccagttactgttctaagtgttttacgtgtattcacttgcttaagccctaaggcgggtaccgttattttccccatgttatgggtgaggaaactgagaaacagagaggttgaagaatttaccttctatgccataagtggtataaaatggtcagttctcagtcctcattttacttgatctatctgcagcatttgcccgtagatcattccctccttcctggatgactttctttgccttgttttctgaacatcactttttgatttctcctttgagctcactacctattccttctcaataccttgtgctggtttcctctcatctgctctaaataaatcgtggaatgatcattcatcagacctttgctctgcctgcactgactccctatgccatccctcccaggcccgtaacttccaatgctatcagtatattattgatttgcaaaattgtatccctagcctggaccttgaccctgaacttgagactgttggtcttagtctgctcaggctgatataaaaaaacaccacagtctgggtggcttataaacgacagaaatgtatgtatttcttacagttctggagactgggaagtccaagaccaaggcaccagcaacttgagtgtctgaggagggccctcttgttcatagatggcacattattgtgttttcacacagtggagggggcgaggaagctctctgggtcccctttctaagagcactaatgtcattcctaatgactccaccctcatgacctgatcaccttccaaaggctttacctccagccatcatgttggggactaggtttcaatatatgaattctgtggggcaacaccacgttcagtttacagcggtctctctggcctcatgtccaaccatctcccctcctcattcatcccactccagccacgccggcctcttgctgttcccagttacgccaactcgcccccacccagtccttcatgtctgcctgctcccctgcctgggtcgcttccccacgatgcctgctgtggctcacagcctcactgccttccggtctctgctccagtgtccctgaatagagtccaactctgagcatgctgtggaaaagggcctcattccaatacacaaagtcccttttcccatgccctgccttactgttctccataggtcacatgtgacgtgacctgtgtgtgcttgtttactggttttgcttcagaagagacctccgtgagagcagggaccttggtttgttcatggctctatcgcacaactgggtataataggtgctcgataaatattctgttgaatgaatcaatgaagttgccacagggaaggcatagacatatgtctttcaaaactccatgtgcttggtctttttaaaagtaaatttctttgattgtaaatagattcacattgatacttgaataaaatcataaaggtatgtcttctttcctcttcctttaagttttaagacacttataaatgtacctgaaattgtaataaaagatcccagaggattttacagcatgttttccgttgatggtaatggatggaaataatttaaataataacattaacaggttgttttactacaggaccacaataattttaaaagacaaacttgaataatcctgttttaccacatccctaaacctatgaaacacacagtactcactcattaatgttgatttgtttaagagaaataaacttcaaaaaaaaaaaaaaaaaaaagccaacaaaactcactctgatattaactgcctcgggtttaaaggttttttcagaatgcctcagtaatactggcttaatgaattaggttctaagaaaaatggccaggcatagttaacaataaatcaggttatactatttgcagaaaaagcaactaaaactctccttgtaaataataatgtggaaagatctggtattaatcaagccactgtctacagctgagctctgttttcagcttctgaacacagtggagttaatattgagcatatctttgtttcaagtataatgaacacaattctgcagtcctttgagaacaggcttttgtgaaaaatcagtaaggaattgcacctaaaacccatttacaagatcatactcccaaaggctttgtcttagagcagtttttaaaatcttgttggtaacctcctgaccacatcattgggagtacaaaaaagtgcagagagtatatatatatatatttttttttcataaatacttgcacatcacatttcccctacggaaattcaaccagcggttccaaagactgctgggctggagttgtccgggttggtggacccgcctgagtctggggtagcttagcttgttcagaggtgtgcacagggctgaggaccttctgtgcgtagcagagtcattcatctggtcaatggccacatgaagacacagatcttgccatatcagattctccttctttctactggaggtctggtgactttacctgtgttagttcaggcacctctggataacttaaggactcaccaagcggcaggtccttatgtagctccacagaccaccatgaaacccttcgaccttttctgaagtctgccttacgtcttgggccactgaacattctgccagtcctgaagaacgtgttgattccagtctcatcccagtgcaaagtgtccttctcatctttgggctgctgtcccctgagcaggaatgccgtccccacagctgatctttgaccatgggtagactctggtctaccatatgacctgggaccatcaaagcccaggttaagctgcatcccaagtgtttttctagccagccatgccctgggggtactttccattttattggtcacggagcactcaggccctgctccaggatcccaggtatggtctctggggaaaactgaccacaggttgtgcaggaggaaccaccagacctgcccgagaggggacatctcttctctttggtctgctgctttgagacaattccaagatcgcagtgtatatatgtgtgaagtcttcatgggtaactatctccaaagcatttaatgattctctttccttggcttataagtaggctgataatggaagttcaaatgatgtgggactctgttggtttgtccttctggaaaatcccactcctcttcctggtcaccaaagcagtgaggggaggagggcaaggaattgactcctcacatgtattctaacaagcatggaacagagcacacaagacatggatcttactgtagaccggggaagacactgagccacttctggctttatctcttctgacctatgcattgggataaacttagctgagcgcgtttccctgtccgcatggagggtctggaaaatgagccggacattgagctgggcttcatactttcatctttgcctctctctagagccaaacaaaggcttacctgggtgggccctttttggtcctgtttttctgtcatcgctgttgatacgtgggccttgagctccctagttgcaaactgggaagtgcattgaatgagaagtgtgtggcttcttccctggctatgccttttcacgtgttaaacatagggaaaactcagctatgccttttcatgtcttaaacaaagagaaaactcagctatgccttttcccgtcttaaacatagggaaaactcagctatgccttttcacgtgttaaacatagggaaaactcagcatttgtaataacatgttatgtttatagagctcttcacaaagtgctttgatgtctgtgattccatttaatctttacatcagcagcaggggataagtgttatcccagtcttactgatgaggaaaccaaggctcaagaagattgaatgatttggccaaggctgtgacactagaaaaggcaaagcttggactaaaacccaggtcttcagaattcaggtccagagctctggccagtctgttgactccttcatcagctcccaagatgaagatgaggagctattttctgttttgagcctttgattacagcttgttttgtaatacaccataaaggttgagaccatgtttgtttctagcacttacaaaaagacctggcccaattagacacttaataagtgttttataaatgaatgaaattagtgagtgaagaggtaaatgaatggatatattgaatgaatagattaactaggcaaaaacctacctgtctgcatttatattggaaagcactacatgaaaaaatgagatttgaaagttttagaatgtggctgtgtgtgtgagagagatcgtccctcaatctttcatttcttctgattgtctatcagtagggaaggtccaagtcccacccatactgtgtttctcaaatattctcaaattgtattgaaacctgtaaccaaaaccaaagttaaaattgattttaaagtgtcttctaggtttttattctaccattcctacctccagttttttgtttgtttgtttgtttgtgttcctttttgagacagagtctcattccttcactcagactggagggcaatggtgcgatctcagctcactgcaacctccgcctcccaggctcaagcaattctcctgcctcagcctcctgagtagctgggattacaggcacccaccaccacacctggctaatttttgtattttcagtagagatgggttttcacaatgttggccaggttggtctcaaactcctaactgaaagtaatccatcaaccttggcctcgccaagtgctgagattataggcgtgaaccactgtgcctggcccacctacttccagtttaaagtcacctgggaaatacttggagtacagttttgtcattttaatccttttttggaccacaacaatcactttacgaacatttttttaactttttcagaatcgattcaaggaaaagtgatagaggcaggtggggacggggaggtgagttttcttcgcatttttgggaatctcaactcctgagcctgtcttactagtacgggttccccaaccccacgactagaactatcttagtggtttcttcctaaagagatgtacacgtgtgtgtgtgtgtgtgtgtggtgggcgtgggtgggtgtgtagagtagggaaaaggtgagaagtggctctcttgctatagacttttgctttttactcttttccactgagtctgctcatattattcatacgattatcacgttagaggttttggagttgtagtggctatcgttttaagtttcttgtagaattaatttatataagtagacaatgtatatgaattgattgattcaaatctgtatcttacaggatctgttaaagatagtcagaaggctgtcttttaaaatgtgaggacaaatcagtttaacagtatagcagagaagtacagctgtgctctgtcaaactctaggctcctgtgtgttggaatgactagaggcagcagggagaggggtcctggtttactcaccccctctccctctttcacatactagcttgggcttgttgtggttgaggtggtgtgggaacatctagaaggttcattcaaaaaagacagcctcagcctttgctcagacgctcaagatgttctgccggctctccctaccatgaaagttctctgagaagccagtaaagatggcagcctctaaagaggttagctttatttggtggaggggcggtaggggtggcacacaccgaggaagattcggatcgtggcacatccttgtggtcaggcccagaaatcctcattgccctgcagccacccaggtcatgattcatgaggtgggggtctaagctgagaatggctggccggttctctgacttcgtgggtgtgtaatagttggttgcaactgacttctcaagaatgacagttactgactggagctggcagagaggtgtggccaagttcctggagaaatgcttcctgctcctcccgccctccccaccaccatcctgctgtatttaaagctgctttggtgatgctttgctcatctcagtgaattttcagttcagaccttttcactaaggatcattatggaagaaagaggggtaagaagtgtggctgagtagcctaggattaattcatcagtccccaaataagcaaacacgatgtctcaggatggacggtgaaattctggacctcacaggtaggtcttggagttgttagttgtgaatgtagacccccaagttcagatgttgccaggattttacatcctctgcttaaggctgtgttgttatttctgatgtttatgagtgaaaacaaaaacatacagctcaggtccttatcctctgagggtctcctcagcctggggcacctcccgccaaacgcttcatgactcccccaccaagcacatcctggcacaatctggcatgaggtctgagctacataaatgtggttttatgagggaacaaagcaagttttggttttctttagaattgtacgaaattataccttcaagatgactttgccttatcgtggcttttgttttgcttctccgagaaggaaactacaaagttaccatgatgtaaatccggccagaggcttgaagtgatttcatagtaaaagccacctcagccgtcccctctgaaacccaggccaagaggcagagatgccaatgacaggctctgtgaccagcctcgtaagccatgaaccagatccacggtttcacatggccaggacctcagggccgcatcagcctcttccaccacactctctcgtgaacagctggtgacactgtcagcggcgcctctgtcacaaggaagggcaatgtcctgtgtagccagatggcgggggagttggaggctgggccaggcggtcaggatctgcattccaccagcccgtggggttttcatagccaggggcactgtgtccaccttgggcgtggccatacacagccaccacttctaaccccattgccagctacaacggaagagagcatgctgtttagagttcagtacctccacataagggaaactgaggtagaggagagccggcattagcttctgggcttagaacacccaccttgccctcctgcatcgagattcatctccagtgagagcaggtgagaaggaatcagaggagagcacctaggcccgggtgtcaaccttgaccccacggacatctaggactggatgatttttattttattttatttatttatttatttttgagacggagtctcgctctgtcacccaggctagagtgcactggcgcgatctcggctcgctgcaacctatgcctttcaggttcaagcgatcctcctgcctcagcctcctgagtggctggggctacaggcacccaccaccacacctggctaattttttgtattttgtttagtagagacagggtctcaccatgttggccaggctggtctcgaactcctgacctcaggtggtccgcccatctcggcctcccaaagtgctgggattacaggcgtgagccactgcgcccggccagtgattcttttttcaggtgctgggatgcggggtgctgctctgtacagtgtatgatgtctagctgcatccctggcctctactcactagacgtcagtagccctctcccagttatgacaaccaaaaatgtctccagatatttcctaatgtcccctgagcatcaaaatcaccatctccagcctgggcaacatggcgaaactccatctctacaaaaaatacaaaaatgagccaggcatggtggtgtgcagctgtagtcccagctatttggaagcctgaggtgggaggaccatttgagcccaggagagtgaggctgcagtgagctgtgatcacgccactgcatttcagcctgggcaacacagtgagaccctgtctcaaaaaaaaaaaaaaaaagaagaagaagaagaaagaatttaaaaaacttaccagcggtcaagaaccattggagtagagagagaatttggtgaaaagacatctgcattctacctttagtctctgggctatgtctccggggctatttatcattgtcttgaattattttgtataataagcagcagcccccacgctcaggtgtttggaggagttgcaattcactgggtggagggtagagcgtctcatgaaatcctcggctcctgtctgaaggccacagctggggtgaggcccttgaatgggagaggcagatgtccctgtctacttcttccttctccctgcctcctcttggccttccttcccatcccctcctctgtgacagcacaccacaccgtcacctgggtgctcgtcagcacgcagattccagagcccggctccccagagattctgatacagggggtctgagaggggacctggaaacctgcctcactgtgagcttcccaagtgactctgcgcagggggcgtggtgaggtcacactttgagaaacaggccctagaggcttttctgaacacacgagccctcccagtactcccaggacactaaagtgtagcagaaacaagcaaaaaaacacaactatactagcaaacgtgacaaaagcaaaaagggataaaaattcctaagaaaggccaggcacagtggctcatgcctgtattcccagcactttgggaggctgaggtgggtggatcacctgaggtcaggagttcgagagcagcctggccaacatggtgaaactccgtctctactaaaagtacaaaaattagctgggcgtggtggcgggcgcctgtgatcccaaggtactggggaggctgaggcaggagaattgcttgaacctaggaggcagaggttgcagtgagccgagattgcaccattgtactccagcctgggtgagagagtgagactctgtctcaaaagaaaaaaaaaattaaaaaattcctaagaaagatgaagctattcaatgtgggaacctctctcactgaaaatggattcatcgagtcattgattgattcgacacatggcttctgtgtgcctacttgacttcaggcattattctaggcatgacgcattccgcagtgaacaacacagacaaatgtgcctgctgtcacctagtttatattttgcagggggagacagacaatgaacggaatgtagttagaaggtggccatgctgtagagagaattaaagcagagaaaggtggttagggagtgttggggctagtttgcagtatcactagatgatccaggaaggcctcgttgaaaaggtgatccttgagaccttgaaggcggtaagagatggccaggcagatatctgcaggtgagagttttctgggcaggaggaacagcaagtacaatgtcactgagctgggagtggacattcctggtgtgttcaaggaacagccagaaggctttcatggctggttcaggctgagtcagggaacaagtgtaggagctgagggcagagagggaccaggaggccgagtcctgcagagcccatggcagggacattgactttgactctgaaggaagtggggcgggggccaggggaggattttaagccgaggactggcaggatcagatttaagattgaaaaggatcaccttgtctgttttcttgagagtggactccaggtgggtaagagtagaagttatcattactattcaaattatggcacggtttctgccccctaggaattcactgtgatggtggagatagaacatgtacagcttaagtaaggaaatgtttgctaagtgctatgaatgacttagagaagtgctgtgtgagtcagtgaagggagacatcccttctgggagtcagacttcgcggaagagcggggccttaggatgaatgaacaagactttggtttttttagtgtgatacataattcaccatgcacatccagtgaatggtacacatttaaagcgtacactttgatatttttggacatatgtatccacccatgacgctatccccacaattataatactgcacatatccatgacccccaaaagttttctcatggttgatgagggagagagggagttatcatcagggcaggaaccaaagtgaaggtgcagaggctgggaaatgtaggggcttccatgagacagagggaggctggtgctggtgctcctgggggaagtgagggacgtgtgacaaggtggcctgaagaaaattgtgtggggcccaaaacactgggtcacaggggaatggggcaagtacttaaatttttgtaggacatggtcaaatgatgtatttgttaaaattccatcttttttcttttttgtgttgagacatggtctcgctctgctgcccagattagatggcagtggcgtcatcatagctcactgcatcctcagcctcctgggctcaagggatcctcccacctcagcctcctgagtagctgggactaaaggcatgcaccaccgcacctggctaatttttgtattttttgtagttgggatttcaccatgttgcccaggctggtctcgaacttcagatctgcccacctcagtttcccaaagtgtggggattacaggcgtgagccaccataccctgccaaaattttaccttttaaaaacaatggcaacaccaccaaattttaggtatttaatctttttgtagtaagtttaagaaaacacagccaagggcggatcatgaggtcaggaaatcgagaccatcctggctagcagagtgaaaccctgtctctaataaaaatacaaaatattagccaggcgtggtgatgggtgcctgtagtcccagctactcgggaggctgaggcaggagaatggtgtgaacctgggaggccgagcttgcagtgagccgagatcgcgccactgtactccagcctgggctacagagtgagactccgtctcaaaacaaaacaaaacaaaacaaaacagccaagtacatttatgcagcatttcatgaatatgaagtcaattaaaagaaaaagaaacattaagcaattttataattagataattaacagaatccttgatagccttatactaatacaactacttgcagattgaaaataattccatttgctgcctgctggcacattaaagcctacatgtaaaaaatacatcaagtctagatgggcttcagtcatttgaaagtaatattttagtgcattctagtataatcttgattagtgcttacatgcgtatagttcagcactttattttgtgtcatgttgaacatgaactttaaagttaagggaaacattttaagtacgtagtaggaatctactttcccatcttaagctctgaatctatttgtgaagggatcctatttcccaacagccaagggatatactggagaacaagattttcagggttgaagatacgctgatgtgaaatcaggtttctctctctttttttttttcttgagatggagtcacgctctgttgctcaggctggagtgcagtggcgcagtctcggctcactgcagcctccgcctcctgtgttccagtgattctcctgcctcagcctcccgggtagctgggattacaggcacgcaccaccacacctggttaatttttgtatttttagtagagacggggtttcactatgttggccaggctggtctcgaactcctgacctcaagtgatcctcctgcctcggcctcccaaagggctagggttgcaagagtgagccaccgcgtccaggccaggtttctctttctacatcttctgggaaaaggttggcagctcctaggagatactgaccagttagttgatgggtctgtgattcaaatcgaacatctagcaaagcccctacgaagcattagtcactcttgtgggagaaatgaggaagcgttttcagtaggctgttagagtgagaagcatcagattcttagttccatggaaatgaacgcctcttggagtgtttcatcttttaaaatagagaaggaagctgagagtcattcaggccatgctcagagatgtcagctcaggaactccaggaacccagtattattttgattccttccttccttccttcattccttccctccttccctcctttccttacttccctccctcccttccctccttccctcccttccttccttccttccgatatgggttttcctcatgttgtccaggctggtcttgaactgctggctcaactgatccacctgccttgctttgggctcccatagtgctgggattacaggtgtaagccaatgggcccagcctattgtgatttctttctttctttctttcttttttttttttttctgagacagggtctcactctgtcacccgggctggagtgcagtggtgagatctgagctcactgcaacctctgcctcccaggttcaagtgattctcgtgcctcagcctcctgagtagctgggattacaggcacctaccaccatgcccggctaatttttttatttttaggagagatggggtttctccacgttggccaggatggtctcaaactcttgacctcaagtgatccacccaccttgacctcccaaagttctgggattacaggtgtgagccactgcacccgggctgatttaagagggctttgacttgaccagatgtggtggttaagtgaatatgatatgttcccttctttatcatcctctctgttcttaattgcaaaagcgccaaatcctcctagataaaagacagccctaagatcattgtcaccatcctccttatcctcatcccaacattatatgaagttctaaatttatacaagttactgtattagatactgagactagttacattgataataattactaccatttatttaagggtgataataattactaccacttattcagcatttaccaagggccaggtctgtgctaaaaatgttgcacatattatcacatttaattcttacttaactcaataaaataagtatgattattgactcccatttttacattaaggagactgaagcttagagagatttgtgaaaaatggctcctggtcactcagctactaagtaatagaagcaggacttgaacctcccatacccttaaccaaaagttttcaaaatagtcaacactgtccataccatctagttggaaaagatgagacctggacataaaaactggccaggcagagtggctcacgcctgtaatcccagaactttgggaggctgaggtgggcagatcacctgaggtcaggagttcaagaccagcctggccaacatagtaaaactccatcggtactaaaaatacaaaaaaattagccgggtgtggcggtgaacgcctgtagtcccatccacttgggaggctgaggcaagagaattgcttgatgcagtgagccaaaatcacaccactgcactccagcctgggcaagagagaaagactctgtctcaaaaataaataaataaaagcattttcaggggttgtgacgagaaatgcctcacccattcttttgagtcatttatgaactgttcttaatcatgttacgttctaattaaacatctcccttttcttttgacgtggaaaagtctttaccttctgcaatacctttttcacatgttgcagcaagcagccctattaatcgcattcccacctgcctttggccctcccagctgcctcgcttgcagaacacgatcgttcaaacggaagtcattcatgggatcgcctctccctgcagtaatccagagcagaatcacttaggctgagcacagctgctacatcccagggtaatttggtttcttatgtagaaaaactgcggtctgacatttaacatttcctcctctggagagtgtttttttctttttttgtctctgtgaacttattacccagcatgtcttcacgcctttacattcagcgtgttcacgtgctcagcgcggtgttcatgcccgcaccattgtgtgatcaccatcactgggtgaagggctgtgggcttacaaagcagactgggaatcacaatgacaaaccttgggttcagactccgggtaggacagaaggaagtttctacctgagtttcatgctaatcaagtaggggtgcaggcgatcaagcaggggtgcaggggtgcacctgcgatctcagggcatggcctcgttgctgtcactactgcggttgttattttggctgtctcaggcctcacctggagcaaaccctaattctaacacactctgtgttctttcagatatcactcccctcttcttttcccgtctttccagaatgcgctgtgcttgtgtcctctttgccaatcagagtgagccgcttggggactttagtccatgcacatgtcgtgtcagtgcagatgatagaaccttgagggtggtgacttccccacccggagccatgggtcgtgattcctttgtcaggcgttctgattggttcctggcttccctctgcggtggtcgtataccttgtgtgtggttctgggagctcatgaacaacaggaatcaaggacactgacctttcgccatcagcaaactcctgctgtgtagattcaggggcgaagagagtctcgcggtgagaaatactctgggtgagaatgaccctctgtgtctccttggtccttcacaccccatcaagcacaggcggatcaggagatgtaaaggtcagggagctggtaagcatcgacgaacaaaatcttcctgaggaagggccgggtgcggtggctcatgccggtaatcccagcacgttgggaggccaaggtgggcagatcacgaggtcaagagatcaagaccatcctggccaagatggtgaaaccccgtctctactaaaaaaaaaaaaaaaaaaaaaaaattagccgggtgtggttgtgggcgcctgtagtcccagctactcaggaggctgaggcaggagaatcacttgaaccagggaggcggaggttgcagtgagccgagatcgcaccactgcgctccagtcttgcgacagagcaagactccatctcaaaaaaaaaaaaaaattttcctgaggaagaagtagcatccccgagctggcatgttgggagtatccttcaatttcagatgcttaaattctcctctctgacaatggctaattaagatttggccacattatctttatttctcttcttttgaaattagtgaggggacctgaccttgggtgatccgcccacctcagcctcccaaagtgctgggattacaggcgtgagccacggtgctccaccacctacgtgtcttcttgtattcctcttcatgggagaagtagggaaaaaatgatttggtatatattcctgaaagataagagtgttctaagtatcgaatccttacacttaaaactttaggttgaaaatgttgcccaagtgccaataaaaattgggaccttaaacatagaagttcaccttgtgggtgggcccatcgctgctcccgtgagactatctctgatccaggatggatcagagctaggtgatacagatgtctctgaagcccacgagctaggcagcacgacagactggatgcttcttttggtgccagctgatccagaggacatggccctagtccatctcctagggccactgccattctttttgtgtccatatcaggaaagcatggtataattcgaggcatctatggctctgaagacttcttttctctctctctctctttttgagacggagtctcgctctgttgtccaggctggagtgcagtggtgtgatctcagctcactgcaacctctgcctcccaggctcaagagattctcttgcctcagtctcctgagtagctgggattagaggcatgcaccaccaacccagctaatttttgcatttttagtagaaacagggtttcaccatgttgggcaggctggtctcggactcctgacctcaggtaatccacccacctcagcctcccaaagtgctggggttacaggcatgagccatcacgcccggcctccttttctcttttcttcctatttatgactaccctcccttaaagcagtatcttctttatttcagcacttacagaaagctatggctgttgaccattcctttttgaagttgtgagttgtactaaaatatttatgtataatgtgtggataagcacttgatttactgaggccttttgatgataagaactcacaaagggttttagatcaagggtggcttcattgaagaaacacctctgacatcagccagcaaccgcattttcattaaagactctcaatctcagcctttccctggacgagagaggaatgggttgttggctacttcctggctgtctgtggcggtcgtattgatgttgggcccagctgtgctgaatggctctgttggtgctcgctgggcttgctttggctggcacagctgtgagtggaggacagctgtgaggagcgggagttggtgctgattgatgtcttgtgaaccccggcggagcactgagctccatgtatgtacggattggtcctgtgagtcactacagactgggctagaggtggcagcagaggcatgtggcgttaggtagtacaggaaccaagaaggccctctggactgtgaactctcagagaacgggtgttgttctcatgcaccctcagacccccagcctggggcaacactgggcgtgcaggaaaccaaagtctccgcttgttaaatgtcagcagctgagccacaaatggcaataagctgaataaagaaggtggtgcttcaagggagaggagtaaaaacaaggaagaaaagagaagaggggccctcagagccagggatggctcatgcggtttctggagagtggttgtgtccctaggtcagagtcaaatccagactccaagggctagcgttggaaataaactgtgatgtgcagacatgacttctcaccctctctctctctctttttttttttttttttttttttgagatggagtcttgctctgttgccaggctggagtgcagtggtgtgatcttggctcacctctgcctcccgtgttcaagtcattctcctgcctcagcctgctgaattgctgggactacaggcgcccgccaccacgcccagctaatttttttgtattttagtacagatggtgtttcaccatgttggccaggatggtctcgatctcctgaccttgtgatccgcctgcctcggcctcccaaagtgctgggattacaggcatgagccaccgcgcccggctgaaatgacttctcttagagctgcctcctttctgtggcacctcttccatatgattgggttagtaaaaatattctaaataagcaattgatttgaggctttttgaagccaaacagtttggtgccttgagagcataagccattgcttatgtgaaaaaaaacaagaaactgtatctttgcatatactggggcccaaataaatcccgtttgaatgaatgaacatttcctagtgaaaacatggggctggaacccttctgtgtccgtgggaaaataggaatctattgatggatatggctctttggcttaaagtgaaaaatcatgaactggtggtcaagaaatctaggcatagtccacgcttttaaccctctgggacctgtttttctgtaaactgaggtgacgctctgttctggaacagcccctaaggggccgtttcaggtcctgctacacgctctgagttgtgattagagactctctggccctgtcatcgaggaggacgcctcgagacaggcctcatatggtttgcatcacttcctcaaccagactcgctcaacctgaacctcccattgcttcccatcattgtgtctggctgtcttgagtgtctccctcctgagccaccccttgctgctgcagtgtaaagaggcctcttgatttattaatcaattaatcagtgcgtgctgaggagctgttcggggtagttaaacagggaaaacaaacagctggagcctgcaatcaagatggatcctaattaagaaccaccccccaaatgctgatcttcctgccccgtcactgcctcacaactcccccccaccagcctacagctcagcaaaccgccttcagctctgatggggcttctaccccatgcaagctgacagtgaatttccgaagggcagattttctccctaatgtcctagaggtaaataagccttgagatgagcgttatcaattacctgcaacgactgttgagcccccaaatggcgtagtagccctgttcatataggcacagcccacactctcctatcccagttcccccacgaacggagtcatggagctggaaggtccttacgataaggagaggccatggcgctgtggacagacgagaggttcagtgaggttcagtgagttgtctgaggtcactgcagaactccaaggtcacaagtggcagaactggaaactatctgatactcaacgaacactcctggtgcttgtttctctgtgtaatcctaaagcaaagtaaataagagacattgttctcactgaatccattaaatgcttctgttccagtggtacttagcacacaatgctgagaaggccaagattttcttagaacagaacctctgttcgaggttgcaagttgcacctccatctgcaactaactttctgtggtaacagggggccaagggacctcagtgcagtggtccagaattgcactcaccccatatcatgcctggacaaatgtttgttccttctgattgaacaccttgggagagcccagggatggctataattcttcagtggatgtaagaataagaatgttcttgccaggcatggtggctcacgcctgtaatcccagcactttgggaggccgaggcgggtggatcacgaggtcaggagattgagaccatcctgtctaacacagtgaaaccccatctctactaaaagtacaaaaaattagctgggcgtggtggtgggcgcctgtagtcccagctatttgggaggctgaggcaggagaatcacttgaatccagaggtggaggttgcagtgagccgagatcgtgccattgcgctccagcctgggtgacaaggcgagactccatctcaaaaaaaaaaagaaaaaaaaaaatattcttgaccagcctggcgaagaagatacttagaagtcttatttatttttttaacttctttttgaaagttttcactataaaattcttacatttgtctaatgtgtttatcaaaaatagaggcttttctgccagtgtgtcttctcatttctgtggaatgccaatcaaactatccaactctttgagtacgtctcgggtttgactggtaagccaggtatctgacttgcactagcagccttggagttatagaatctcctctccctctgcttctgtgttctgtaggaccctgctttctcggctgtgattcacgacaaactccaggtccccaacaccatccggaaggcatggaacgaccgggacaaccgctgtgacatttgcgccactcacctgaaccagttgaagcaggaggccatccagatggtgctgacgttggagcaggcagccggcagtgagcactacgacgcctcgccctgctccccgccaccgctctccaacatccccaccctggtggggtcccggcacgtgggtgggctccagcagcccagagactgggcctttgtgcccgccccctgtgccacctccaactacacaggcttcgccaacaagcacggcagcaaacccagcagccttggggtcagcaatggggcggaaaagaagagcgggtccccaacccaccaggccaaggtcagcctccagatggccaccagtccaagcaatgggaacatcctcaattcggtggccatccaggctcaccagtacctggatggcacctggtccctgtcgagaaccaacggggtcaccctgtacccataccaggtaagtagcctgtgtgagccaggaagagcagggctggctggagtcaaagcggagaagtaggcagcacttccttccgctgcctcctcccgggaaccctgtaactcagagcccagtgtttccatgtggcccccacagagttctcatcaaggtgccccacccgggcctgcctgctttgagagggtgttgctacatcttccaaactttccacacctgccctttctctgctcttcagtgtctccttcctgagagaccctctttgtgtaagaggtccttgctggtccaggtgatgccagcgacttcccagccagcagatttaccacatggcagagccatgaagaggtaggccacacagatacttggactggggtccaagccccgacttgtccacttattagcagcgtgacttggcacaaggggtttgccctgtcttaggctcaagtccctcatttataaatggatgtgagtcacgagaattaaataaggtagtgtttgcatgacatgtaggccaacacctgccatatagtaggggatcattgttgtgcctgttaacagagattttagatattaagtgagagtgagatgagtgagatgcttttgaaccaaaggatattgtgagtcccaggaatcacggttttaaagcagcctgtggaagtgctggacattgctgagaataaaatatacgaaggaacagtgatccgtgttggcactctgccttccctgtctataccttccaaaagaggtgtagatgcccttcttaacctctcctcccttgacagacccaaattcttttctatttgcaactcaccttaagaactactgggattgggctgccaaaactgtttcttccttttcagttatttaaattagaacatgcccccaagtttctccatagaaataaaacacaggtcttaaatctcccagggaatctttaaagatgttctaattttgcccgggtgagttttctgttggatgaggactggatttttaatgtaagtggcctccatatcccctgcatcaggggtgtgggaagcagcagagagcattgaccgtcactggaatggagaggcggccacggtcaagggtgtattactcagagaagatagttggtacatacagcaaatgatcctggagacctcaggctttttctcacttgggtctgtcatggtgggtgtttggtaggtggccttctgctgcgatgtgaggactcagactagagacctcaggttatttctcacttgggtctgtcatagggggtgtttggtaggtggccttccgctgtgatgtgaggactcagacttcttccaccaaatgcgtcaccatcttccaggggcctcaagagtccttcaccagaccttctgtaaccagccaggaaatgagggaagatagagtgtgtggaggatctcacaggaggatttggggcccagctttgcatggaagtgatgtatgttgcttacatctatattccagtgacaagaatccagtctttgctgggcgtggtggctcacacttgtaatcccagcactgtgggaggccgaggtgggtggattgcttgagtacaggagttgaagaccagcctgggcatcctggcgaaaacccgtctctattaaaaaaaatacaaaaattagccaagtatggtggcatgcgcctgtagtgtcagctacttgggaggctgaaacgggaagatcgcctgagcccaggaggcggaggctgcagtgagccgagattgcaccactgcactccagcagcactgcactccagcctggtgacagagcaagactctgaattgggaaaaaagaagagtgagagagagagagagagagagagagagagacagacagacagacagacagtttagtctcttgatctcaccttcccactggtgaagctggggaagccaatctacccgtgagcccaggagaaaaaggaacaagtcgagtgaacacatagcatagttttgttacgccggacaagatacagggaaacgtggagtgagttaaatgtggttgataaaatgccgggtgactttctctagagcgtttgagagtgttcatgtctcttgctatcttgaaagaaagtgggaaacgttgatcattatcctaagatattagcattcttggacggtcgaaattttcacttaactgggtgctttctaatttacaaaatctaacatatggattatttcctttaaccccacagtaggcctatgaggtaggtggggcaggtgttagatcttccttttacagttaaggaatatgatgcttagagaaatggactgattgtggccacacagccagtggcagaaccagcaccagctctccccttgcccagggaatggctttgcctaccgcggtttcttccaactttcctaggctaccccaaagtaagctgccgacatcttttccagatatggttccttttcagacctggtgtcacaaagaaaagaactcgttttacctgcaggggcctcactgcccctagacttttggatagaatcttctgggatgtgtatataaatataatgaggaaccagtggcgtcctgtgcagtgcttcacattctaaccttggaagtaaccttctagggcaggaacagagaagggcttctttgcatcatgggataatttgcttttttttgtttgcagttttaaaatataccatttagaaaattatcaaaagtaacatatttgttgtaaaataaaatttaaaatacatgaggaagtttaaatgagactttaaaagtcgatgtcacccggatataaactatgtaacatttggggatacttcctcctagcatttcatacactcgcaatttgtaaaattgtgaccaggttcaattctgtgacctgcagttcacttaatacattgggtacatttccccatgccactatatgtttccctaaaatattatctttagcagtaacatatttcattatatgaatattttccacgctatggagatgtcctcatttattaggttggtgcaaaagtcattgcggtttttgtcattactttcaatggcaaaaaccgcaatgacttttgcacccacctaatatataaccaaacatcaattaattagaatttaggtctttgctactataaatacaatgctcaggtgaacatccttttacccaggccatagtttcaacacatgcctggcttgtgtgagccacatacttgtgttacacagacaactcacatttcaccttccaggactccgaagctcttgtcacacgtggcaggggccggttagaagactcggcggctgcgccagcgctgatgagcgaggacagaggagcatgaaactggtgctttcctgtaaaatattcaaagtgaggtgaaagtttgtgtgtaagtcggaaacactgaagatgctgcttaaacggccgattagggattatttgtgcgtttcttttatttgtgcaatgattctgttcttcctcttacttcccaaactcagatgaaagagaatttactgtacaagtatttattaatctctaaccaagtaccaggcactgtgctaggtggtgggtggggccgcagccttgggctggaaaccctggttcctgtcctgaggtccttgcagtgggacagaaggcaggtgagtgcagaggtgaagagatgccgcggtgctttgggggcatgcagacaggctcctaatcccgcccgatgtggcaaagccagatacaaccaagattcacacaagccaccaacttgtggtcatcctgggtatgttctgttgcttctttccaactccagaacagaccaattcatgcatttcccctcagtaatgaagggaccagaggaaatctctctgggataaagagatttggtgcctggctatgaatctgcgtcccctgtgttgtgactgtgtcgtcctgatgccctggggtgggggctctgggtctggccagactgagtgtctcctgttgcggacatctccctgcagtacatattgtacagttcgcagtctagccagctcgtcagagacggttgactgctctgaaagctgacctcatttttcctgcttacccatactcccacttccctccccacagagcagatggcctctggatcagtgccagagccattccccgggcagagaagcatctagaccttgtcactaccaagggtgcggctccacacccgcgggacccgagcctctagaaatgagggagaagacgactctgcctttctgcaatttagacgtcgcaaggatgaaaacgatgcggacaggctttccagcagtgagcctggggaaatctgcgtcacatgggcgacagaaggtccctcgaatccctcaatccccgtggcccgcaccactgtgtaataatctccaaaggttgcagtaggaagattcttgattctcgtttgctatatccttcacatttctaaagtacctccagaaagaccaggaacctgtaagcatcacagataaataggaatcgatccagagagattttaaaaagagtaatttaggaagtactaagatgacatcaaaaatgttgaacaaaccacaaagataattctcattaaatatcttagaaaattgatttaataggagattataagacgggctttcaaagaaagactttcttctgttcatctgcagacatttagcacaatctatacacacacagagaaagcagaaaattctctagcgcaggggtccccagaccccaggccacagattgataccactctgtggcctgttaaggagccagccgcagagcaggaggtgactggcgggtgggtgggcattacctcctgagctccatcccctgtcagagcagcagtgccattaggttctcctaggagcagaaaccctactgtgaactgtgcatgtgagggatctaggttgcatgctccttatgagaatctaatgcctgatgatctgaggtggagcagtttcatcccatctccgcgccctatttgtctgccatgaagctggtccctggtgccaaaaaggttgggaatcactgctctagaatcttcatcttttttcttccaacttttatttctggtttgggggtacacgtgcaggtttgttatgtgggtaaattgtgtgtcactggggtttgatgtacaaatgattttgtcacccaggtagtgagcatagtacccaaaaggtggttttccgatcctcaccctcctcccaccctccacccccaagtaggcccagtgtctattgttcctcgtctttgtagccatgtgttacagccttcatttgaccacatgaaattgtgactttgaaaggatgtgtctagattagttccttgtaatcaactacagattagttacctctttttgaatggcagctgcttttgcctgattaacatttattatagtcaataactgcaggaaagactgtacacataacacacggagttataggatgttggtgatgttggtgttggaatgcacctgtgtaggatggtaactgtcttttgcatcatggtaggagatttggagacagagtcttacctagttcaagcctgtggtcccaccaactattaaaccagtttagtagcttgacatcttagtctatttcctcacctatgaaattcctacctcatggggtgattatagggaacaattaagaagaaggcgtgaaaatattttatgaactataaagcaggaataccggtataaattatctatttcaaccttttcatttaccagaggagaaacctgaggctgagagatttgaagcttcttttgttcagagttttctaaatcctagtttgatctcttttgctaaatcacacactcttggacaacagggactcattttattctcacatccctcacagcagctaacgtgaaaatgttgttctttattagagacagctcctatctcagggatgcactacaattactttccatgactggccctagtttaggaaagaattccaggccaaagacctatctagaacccaaggatttaggtggaaaccaccaggtatttgattccaagctaatctttaacctgaagtgtcttaatcatacttaataaatccttagatgcagtggaaagaacctcgctggcatttcgatgccacactcaatacaggggcatttgaaaggatagaagagctttatttcataggatttcactcgattgaacttgtcaagaaaattcagaagatgttagcttaatctacaagtaataaatccatagtggaccgttgatgcaatgaaggtcgtccatgtgcattccttgagttgcaggaaaatgctcttgatacaatttttcctgctttctctaaaaacatgcattggaatgaatgtgagaggtaatgctggactgaacactggccgaagtcattatgaggtagtctctattacagctttagaaatgattgcgcctatgaagcacagccattactggactttacattttaagatatgagcacagtctgggcacggtggctcatgcctgtaatttcagcactttgggaggccaaggtgagaactgcttgaggccaggagttagagaccagcctaggcaacagagtaaaaccccttctctacacagaaataaaaaatcagccaggcgtggtggcatgcctgtagtcccagctactcaggagggtgaggcgagagggttccttgagcccaggagttccaggctgcaggaagatgtgattgtaccactgcctgtaacctgggtgacagagacccgagaacctatctcaaaaaaaaaaaaaaaaaaaaaaaaaaaaaaaaaaaatatatatatatatatatatatatatatatatatatatatatatgggcacaaaaggatgtaaaagcaacaccaacctcaacatatatcaaggtttgctaaatgacaggacctctgcggtgcataacacttgctcctccgagatcagaagccctgggggatcttggtgctagaggacttccaagcgcccctgcaggaggaaggtgaggctctgggaggcccaccaagtgctgttgtactcagaggctttgccgattgtggcttcgtggaaagcagaagcgtgtgttctagtatggctgatgtcgggagatgaggtatacacgtgctcttcccggccgaaccacttttcaagaaggaacaggggtgggtgtttccagcaggtcaggagtataggattttcatccacgttcttcgcagctcttgagggctcatccagccacttgtgccctgaaatatgcagcacaccccttcttgggccagcactggggtcacctgcttcccacttgctgctgtgtctacccagtcaggcaatagtgtaagatgccacgattagaccaattatgacgtggaagagattcttaagaccatgggttttgttttctcctgtttataggcggtcaaagggatattaggttatgtatctttatgctttttgacaaattatgaacatggaaaaaagaatcaatttgtatattcggtcatggacacacatttctcaaggctagagtgttcagggtgaaattccaaaagggtagtcacagcttatgaatatggatggggccgtggtctgaagggaacacccagacttcactaggaaacttcaaaaatacgttcaatctgggcgtttgcttggtgtggtagactgaataggggccccccaacgatgcccacaccctaatccccgcaatctgtggatgtgttaccttacatggtaaaagggcctcagcagatgtgattaagccaaggatcttgagatgggggatcatttaatttaattttattattattttttgagacggcgtctcactctgccacccaggctggagtgcaatggtgcgagcttggctcactgcaacctccacctcccaggttcaagcgattctcctgcctcaacctcgggattacaggcatggaccaccatgtccggctaatttttgtatttttagtagagatgaggtttcaccatgttgtccaggctggtctcaaactcctgacctcaggtgatctgcctgcctcagcctcccaaagtgctgggattacaggtatgaaccaccacatccggccaaggagatcattttagactatctgggtggactcaatgtaattacaaggatccttaaagaggaaggcaggaggatcagaaccagagagaggaggtggaaggacagaagcagaggtcagagaggagagagatacaaatctgttggctttgatgatggaagaaggaacctctagaagctgaggacggcaagggtgtgattctcccctagagcctccagaagaagccagccctgcagggccatttttgagttctggtctccagaactttaagagggtaagtttttgttgtttgaagctgctaaatgtgtgctattttgcttcagcagcaataggaagctattacaactggtgagccttctgttaactgaaaagcttggtaaggagaagcgggatggggtctacagaccaaggagtccctgcagaaacctgcaggacagcaagaacgtgggcttttcatctcacacaacaaaccccgttaccctgcggatcggccggtccatgcacaagtcagattctttcatctgggtgccaccacagaatgagaggttactcatactgcaccgctggtttgcgattgtctcagatttccctattgttatagaatcataataagtagcacaccacagcgactctccattggtagctagtcattacaattatgtaagtctcatactgttgaaactgcagaaatcattccaagctgggggtgggagggatggaaggaacgggaggggaaggagagacttcactgaatttcatgtagaaggaagttcatctttgctagaggccttttgatctgatagaaggagatctcacagaactgccccagcaataattcttacctcatctggtaaagatcttcataatgcatgcacttgaatgcactttggacgttgtagagcagcatgtgagtgtttgctggtatcacgttttatctggtaggcaggacacagtcaatggggattccggagcaggggaatgggaagatttctttgcctgaaagcaggaattctcaattttggcttcacactagaattacttgggagattaaaaaaaaaaatcctaatgcctaagccacaccccaggcgaattaaatgagaatatctgcaggtgggacccaggccttggtttgaacttggccaagtccaagaaccacagtgttaaggaagaatttatctggcactggcgtaataggtacagggaagagaacaatgaatgtgtgtggatagatgagtgataggctgagagacaggtgtttgtttcttatggctgccatcacaatttactactaactatgtggctttattttttattttttatttatttttttttgagactgagtcttgctctatcacccaggctggagtgcagcggcacaatcttggctcactccaacctccgcctcctaggttgaagtgattctcctgcctcagcctcctgagtagctgggattacaggtgcccaccaccacacccagctaatttttgtacttttagtagagacagggtttcaccatgttggccaggatggtctcgaactcctgacctcaggtgatctgcctgcctcagcctcccaaagtgctgggattacaggcgtgagccactgtgcctggctcactgcaacctctgcctcctgggttcaagtgatgctcatgcctcagcctcctgagtagctgagattacaggcacgcatcaccacgcctggctaatttttgtacttttagtagagacagggtttcaccatgttggtcaggctggtcttgaactcctgacctcaggtgacccacccgcctcagcctcccaaagtgctggaattacaggcgtgagccaccgcccccagcctgtggctttaaaagcaacaaaaatgtattctcatagttctggagactgcaagtctgaaatcaaggtgtcggccgtgctgtgcttcctctgaaggccccagggaagagtccttcctcgcccttctgttggctccaggtattccttggcttctgatgcatccctccaatctctgccttgggtctcgctgtgtcctcttcttttctataaggacaaaagccattgggtttagagtctaccccaatccagtaggatctcatctcaatccttaactactatatgggtgcaaaagcaattgtgggttttgccattaaaaatcatagcaatttctgcaattacttttgcacctatctaataattacatcttcaaagaccctatttccaaataaggtcacattctaaatagatagacagacagacagacagataactagctagctagataagatagataaataaaaagaagaaaagtgaagttgcagaggtaaaaggtacatgcgggctctttccttgctgaaccacttctgaagaaggagcaggtgcagcatccacggctggtcagcagtggaggattctcattcatgttctttgcttggaggaaaaaaaaggaacaagtggaaaagatgaaaacgggccaagtcgagagagggagggacgtgtcatacctgcatgcatccttatactggaggggagcctctcaagagccagacaaaatgaaaaaatgctcagggacaaagtcaacgatcaacctgtatgcgtgggtttttcatagaataacagcctcctcttctgaacttacagaataccttgtaagtcatttgtgctttcacagccacagacataaatgtaaacagcacctcttgggccaccacctgagagtagataaatttaagttgcgagcctaatcagactgctgctgggggagccttgttccttctctaccgatcaagctgataatttggtctgtattttttgtttttatctttagtaacatttctaggctctaaaaggaggctagaaacagcaggtaagatgctgtgtgccttcaaggggaatttcttagttactagtaatagttacttaccatccctccccctttttgatgtgggtgagaggggttaggtggggaggtggggggtggtgggaatgtggctattatcacccaagcaagggaggagttattttcccctcccaggcaaagcttgggttgggggcagagctgagcatccctgcacagggggtgaaacaggtgggagagaagattgcctagatgtagatgcttttcacagtcgtcttgtgtgttagaggtctgcccacatcctgtctcactcagccaccctccccagaccttgttccctcaggctgaattttcactttcctatgggttgaagaaaagagccagggagtatgcaggctccatggtgagcaggccaagggggaaacaacagctactgctttttttcattttaatgacaaagaaaacagatcgttttagaaagtctgaggctgatactcatcaatgattttatccaaatctcacacaatgagaggttggggtcatgctggatttgctgctcatgcaccagaaataaaacaccaggttccttgctgactgtgtgacctcaagcgggcttcttaactgctatgtgcctgaatttcctcctctgcagagtggaaacttccagagctgttgttgggatcatgtgagagggcgtgttttgcatacttagtgctgtgtgtgacacatggcgacttctccgtgaagttgactgaaccttgagcgccattttcttttactcaactcaagttcatgtgactcaagttaaatggaatcaggaccctcttttccattgtaagagccagtggcagatgaaaagacatcaatcaccaatttcataaagtgaatatcaagcacataaaataaatgttatcctgcaaatctgaaaacattccctccttgacatattgccaaaaaatcaactttccatatgtacatcacatctcgtgtgagaatgtcatattttaagtagatgtgatctcattttatcattagtgaattaataaaatactgaaaggctcattgaccagttttcccccatatttggggatctttctaagggaggagggaaagcagcaaatagattcgaatcatttaaaattttacagcgtagtggacaggtcacatttaaaataacccaaacaagtcaaacgttattattttggaattcatttgaaatatcaagcaattcaggcctagtttatgatttttttttttttttggtttgtgattcttaccgaactctttgaaacacaggactcagccctttcattcttggtttccttatctatatgcttatggtatattattaatatgtttgctttcctattcttttatgtatttataaaatataaacctttcttttaaaattattatataatttgcaagtttcgataaattggaaaattgaaatgtcctcggctggtcgcggtggctcatgcctgtaatcccagcactttgggaggccgagacaggtggaccacctgaggtcaggagttcaagaccagcctggctaagatgctgaaaccccgtctctactaaaatcacaaaaattagccaggcatggtggcatgtgcctgtaatcccagctcctcaggaggctgaggcaggagaatcgcttgaacccgggcggcagaggttgcagtgggccgagattgtgccattgcactccagcctgggcgacagagcaagactccgtctcaaaaaaaaaaaaaaaaagtcctcacctaccccaccccagacatacacctaattcatttctaattgagattttactgtgctaacagtctttagtgtgatgaattagcatgcctttatcttatagaggtatttgtgaggattagttaatgagtcatatatttcatatgcttaagtcactccgagggagtcatttaggtgtttagaagcatattagtcactaattttgggactctggagacttagtccatttctgcagcaccactggccccgaggagttaacatatccctccattgctcatctgagagcctgggcaatgacttgagacactggggagaaaaaaagattccatatgaaaagcaaagacagcagcagccatgtctatattcaaggctgtggctgggagttgtctaattagatgactcatctgagccagcctgatggtttccatcaccttcactaggctgctccccaccgtccattaggctgcaaggcgctgcgtcgccagggaggttgaccccacctgcttgttcatgacgtgctcccttttggttcaagcaacagacatggttggaagcaagactagaaggcagccctcaagaattacaaatgacaaaactgaggcccaggcctgtcaggcgacctgtgccaggtcacacggctaggaagtgacagcgatgggagtcaaacacaggtctcccatgcatttacccctgcccctgccccagcccctctctggagggaaggggaccgattcctcagataggtcagatttgcaggcctcctggggagggttacccaccgcacacactcctgacgtgatttctttgggggcaatttggggtgcctaggatttccaagccaggtttctcatcttattcctctgcatagcagtttagaactcaatgcgctgtattgtatctcctccctgggaggtggggaggttggtggggttaaaaccgaaagacactgatgggccaaaaagatgaaaaaaaaaaaaaaaaaaaaggctgtgtgggcaatgctgccatctagtgagacatactttagccaacctaagaagctgagtggtcctggtagaatcccaccgtaaagtatttcgatgtcctaagcttcatcaaaggagacagggccatctccctgtcagtagcgtggtctttaacacagtagtgaagggttaaattcagtgtcctaacatctgtccttcagaaaggacccgtggcctgaacagatcttctgtgagaatggagcttggttttggcctggtagaaagaccacacagatctgcatgtgagtgctggctcacctgcttagtagctgaggaatgtttgttgttgttgttttaattgtggtaaaatatgcctcatacaaaaaatgtgtcatctgaatcatttttaagtgtacagttcatcaagcttgtccaacccgcagcctgcagtctacatgaggcccaggatggctttgaacgcagcccaacacgagttcgtaaattttcttaaaacattgcgagatttttttggtgttttctttttgttttttaactcatcagctatcattagtgtcagtgttttttaagtgtggcctaagacagttcttcttcttccaatgtggcccagggaagccgaaagattggacacccctgactcttccatggcattaggtacattgacatgatgtgcagccatcaccaccatccatccacctccagaatactctgcatctccccaaactgcaactccacaccctttcaacactcactgcccattctccctcccaccagcccctggcaaacaccattccactttgtttccgtgaatctgactgctctatgtacctcatataagtgggatcacacagaacttcttctctggttaatggtctgttgcacttggcataatgtcctcaagtttcatccgtattgtgtcatatgtcagaatttccttccttttaagggctgagtagtatgctgctgtatgtatataccacattttgtttatccattaatgtatcaacattgagttgcttccatctcttggttcttgtgaataattctgctgtgaacatgggtatacacatgtttctttgaaaccttgctctcaattcttttggatatatccagaagtagaacggctgggtcaaatggtggttctgtttttaatttgttggggagccaccatactgttttccatagtagcggccccattttacactcccacaagagtgcatacgggttccaatttctccataccctccccagtacctttttcctcttcacagtagccatcctaatgggtgtgaggtggcatctcattgtggtgtggatctgcgtttccctcatcatgagtgatgttgagcatcttttcatgtctcttggccattggtaagctgagtaatatttggtaaattacttgaccactcaaagcctcaatttcctcttccatagaatggggatagtatctatcccctagtatagcatctatggcctaagattgctgtgaagattaagttcattattctaaaagaaataaattgtttttggttctgtacactgttctaagcacaggtttgtgtgtgtgtgtgtgtgtgttttgtttcttgttttgttttgttttgtttttgaggcagagtttcattcttgttgcccaggctgcagtgcaatggcacaatctcagctcatcacaatctccgcctcctgggttcaagcgattctcctgcctcagcctcccgagtagctgagattacaggcatgcaccaccacgcccggctaattttgtatttttagtacagacggggtttctccatgttggtcaggctggtcttgaactcccgacctcaggtgatccaccctcctcggcctcccaaagtgctgggattacaggtgtgagccaccactcctggctagcactggttttaaattatatatgtatattctatattgtatatatataaattatttttatgtgtgtcacaattttactaaatatatacttacatgtatttatatataaattatttttagtgaatatatattttatatatatacacacacacacatatatatatatgtatatgtatatatatatatacagagagagagagagagaggcaaactctgacctgagaagctctataaagtcaacccacacagattactcacagagcatggctctctgcttattgcagcccgaaggcaacacatttaaaggtgaggcagacatacctaaaataattaacatgcccctgaaaaacagcagtggaattggtgaatttagaaaaccgaggcatccctcacgtctgaacacggtatccctgaaaaatagcggtggaattggtgaatttagaaaaccgaggcatccctcacgtctgaacacggtatccgtgtgtttttagcagtaatctcatgatgaatatcctgaacacagccttcgtgcagggtccactctccagcttagagattcattcccagcctacttcaaaggcagctgagactgtgtattggagtttctgttcaagacaacggtgtcttgttttcctctaaagacagattgtactttctcatgtaaatagcctttttgatagaatgcaggtgcttccagggattaactgctgctattaggctaggtggcccactctctccaccctgttcaaacagccagtgcttcatcatagtttatgtaactggcaacttagaagcagcagcctctttgatgagtccattaggaggtaggagaaggattggtagcagagaaatgaaagttcttgcacacaaataatgagtagaaaggatgaacggtggttgctggtgctttctgaacaaaatgagggcaaggggtgctgtccactaataagtgtcatttagaggctttattcttctagaaaaagggctgcccatctgctctccactgagaaggtgatttgccgactgttcctgaacgtgtgcctgggttgctaaaacttgcggaacgtgtatcagctgttgaaatggcctttcctttgggaaaactgtgcagacagcaaagagagtacaaaacacgaaaatcttaattccattccctcttctgccactttcagtatgacctcgggcaggttttctacctgcacagagaaaaactgaagtcgcacgctgctcttggttttctcagcctggagcagatgcctttgagcagctaccacttcccgttcccctgacagtgtgctccggctttacgaggctgtttttctctccacagtcaccaagtccactgtctctccacagtcaccaagtccactgtctctctccactttgggggccatctgtgaatatcactaacttagcattacagtaccaaaaataataattatagctaccacttgtgtacttactatatgccaggcactgtgctgagggctttgtgtgtcttaatgcattcaagcttcataacattcctatgaagtaaattattcccattttaattagttagttaattaattcatcaagacaggatctctttctgttgcccagctggatactgtggtgtgatgacagctcatcgcagtctcaaactcctgggctcaagtggtcctcccactttgacctcccacagtgctggattacaagcatgaaccgccatgcctggcccattctcattttaaagataaggaaaatgaggtacaagttgatagaaacagacagtacctcaccacctgcatggaggaatcacgtatttatggagtcctgaacatttaatcaacaactgttttattgagcatttagtttgttattggttgaaattaagaagactggtaaataccatgaattaataaaaagttttatgttaatagtaaacttgtttaggaaatctggttttgtctgacttgaaatattaaggaaatatgtgtaggtttaggtaagaatatatatttggtttaggactgttcatattaagttacatagtcctcagccttaattcacctcacatctccccatacatcttatgtctttttctttcttctttttgctattaaattacagcatcacctcttgatcactctaagacctaatcatctagcttgtaaattattcatacttttccccctcacctcactcctctcttttggattttatccatttatctgcatctctgagaataggtgggcaacagaaataaaaggattcagtgaaaataagttcattctgtcatttattagcaacttacacaacaggtttggcagaaaagaaaatgggaactaaaatagagtaattaaaaagaaagtcacttatttaaacattgcatatcttgctacctcttctaagtagaaattaattagctcctaacagctaactaatagactaagtggaaaatagaccagtgcaacatttggggttaattggtacaaatatattgattacagtaactagtcattaaatgttttataaggtatatatgctattagtataatctctgtatggacatcatctactgagtgcatggatgccgtaaacacatcatgcttagaaccaggcgtttgaacgctgtctggagtacttttacattgtagtaccctgaatgtacatgcctgtttgttatcactgggagggcagctcaggacaggattataaagagatggaaagaggagcaaacctggggcggcgtggagctgtcatgagaatggtattttcgggagctggggaagaggcagagaaggaagggaaaacatttaaagagggcaaaacatggacttcatccgttagctctacagacacggcccttggtagttaggcgacgtgaagccacgtgtactcaggcaggtagtggggaaggctgcttctccaacagatggagacagggaggttggcagaccgctggcttaggaggaagacagcagcagaagggttgcgtgtgtgaaggcagggtcacagatatttagaacgaagcccaaagtccttggagattggttggatgtgggaaaagagagaggatggtgaggctgagactctggtttctgtgccaggtgttgcatggacggtgagctattaaccggtgcagagaaagccgaaagagtaaggctgagccatctgaggtcaggagttcaagaccaccctggccaacatggtgaaaccccatctctactaaaaatacaaaaattagccaggcatcgtggcacacacctgtaatcccagctactcaggaggctgaggcaggacaattgcttgaacctgggaggcgaaggttgcagtgagttgagattgtgccattgcactccagcctgggcaacagagcaagactgtgtctcaaaaaaaagaaagaaaaagaaaagtatcagtttagcaatattgaaatgtgcagcactcaattattagctgtattcagcctgctgtgtaattgatctaaaaaaaaaaagacagatttattcttcctatctaactgaggctttgtaccttttgagcccagtgactccggtgccttgatgggggccgggggctatgacccaggctttgctgagcgatgagggagcgtgctacttctggggtcagggctggagggctccagctgcccatctgggctgccactatggaggagagctagacattgaccacccaccatacaggatgtgtttgcctccccctcactcacaccctggttgtggcgtaggtaaacacagcaaggctcagagggctccaggaacctggctttaagattgccattagcatcatttcctccttaaacaacctcctatttacagctctccatcgataagatatgcaatgaacaacttcatcaggttaaactgcagcaaatgtcaccacttattttgtcactctctgatcttggggggagaaaaacagtgcagcataaaatattgaactgtttactcagtatttagttcattcagtgttttcggatgcccgctacgtgccagcggggagtaaagatgagacaggcttagtccttctcttgagggatctcaccaagtgcagtgtttggtgacgcaggtcacactggggacatgccatggcaggggcacagatatcagctgggggagcagagatgaaggccagatacgaattcccctgcgcatctgaaagaatgcttcatagctttgaattagatgaactgtttataggaacggtaatccagaaacaagtactaaatgttgtatggtagggtgtactagaggctgtattatctgacctaggtttttttttgttttttgttttttgttttttgttttttgagatggagtttcactcttgtcacccaagctggagtgcagtggcgtgatctctgctcgctgcaacctctgcctccccagttcaagcgattctcctgcctcagcctcccgagtagctgggactacagatgcccatcaccctacctggcaaatttttgtatttttattagagatgcggttttaccatgttggccaggctggtttcaaactctaagctcaggtgatccacctgccttggcctcccaaagtcctgggattacaggcattagccactatgcccggctccaatctaactcttgattcctcctttataactattcatcagactgagcaacttggcaagaacctgactatcaaaaacaaattagccaggcatggtggcacatgcctgtggtcccagtgctttgggaggctggggcgggaggatcgcttgagcctgcaggtctagactgcagtgagctatgatcacgccactgccctccagcctaaacaacagagtgagaccctatctcaaaaaaacccgcaacaaactaaaaaaaatccccgatatttctgcttccctaatatgcatgataccagcagcagacagggctgctttgacacctgcccaaagtgtagctggacatctatgtagactcatggagtttggggagaataggaaggcgtcaaggctaagtacaggtcccatctctctccctcatccacttcccccaacctctggtcattcaccaagaaacgttcacagtcctgggctgcgtttactaactttgttctcatgcgtgcttctatttttgaggccagaataggccattttgaaacctctggttccagccttccccttaggaaagtgagcggcagagttgcgacctctctccctggtggctcatctctgggagacgagcgctgtcctcagaagtgacgtggaagctatcgtgacagaggtgttttgggtcagaaactttccattagtatttggagaaaattgatctcattggagaaaggaccatgatatgaacaagtcaggttttttttttatcatagtattttttaaaaaacgttctaaggagaagatttacatgaccactttctttctgacggatacttcttcctggatggaaggaataggaaaagtacataaaatagctcacatggaaaatatttttcctttgatgaaaagtgaaactaaagtagcacttgcaggatgcacttttaattcctgaagcaaaagccgctacttgcaatgctaagtcacattgacgtcccagtcctgattgggccagatttcctctttctttctcatcttgtgttagcatttaaaactgccaagataatgactatgttaattaatctggcccaggatattttccccataaacaggagtgtgactgagtaggtccctcgttccttctacgtctgcctcccgccttccctagagagaagtgaatctaagtcatgctggaaaggtggtgcctaaactgtaccttaagggggaaagggctaacagcccttctcccatagccctttcagcactgtgatcaatctgacccttacactcaatttgtctacaattgtatctctattagcaatgctgctctgagtctgttgggtggaagacatccaattggtgggttgtttctgaacactggaccagcccaaggactatttcaaggaaagtcagggtgagatttgaactgtgcgcacctttgcctgaagccagtctcctgtaattgactctgggacagtaagcattgcagaagacagcagcgtccctgatgttggaaggaagtcaggcttgcagtaaaagcttatccagagaaagaatgtcattctctcaatctgtctctccctctctctctcttgccaggaaagttccgttttgttagctctagtgcttaatgatttcagggttcacactgtgtccactctcaaaaaagcccattttcttttttttgagacagagtttcactcttgtcacctgggctggagtgcgatggcatggcctcggctcactgcaacctctacctcctgggttcaagcaattctcctgcctcagcctcctgagtagctgggattacaggcatgcaccatcatgcccggctaattttgtatttttagtagagacagggtttcaccacattggccaggctggtcttgaactcctgacctcaggtgatccgcccacctcggcctcccaaagtgctaggattacaggcgtgagccaccactcctggccaaaaaaaaaaagcccattttccatgtacacacactcacatgtgcatgcaagtatacagtcttcctggcagaactggaatgagttaaattttgtccatttttattactagaattggctaatagggatccatagcttataatgcatcaacattaaaaatgaaattatattttgaggctcactgcatataaccatgtttaccctctgaaaagatattgtcctcccttgaatatttgacgcagtaaattatgttttggaggaatgcttaagttacctatgaagtatccatttttttaaatgttggttttttctattagtttttaaattaaatggtacatgcgcataatttaaagatctaagtcatttgataagacttgatatgagagacgccagcccaacactgtgaatgcagtgaggcctttcctcctttcccaaggctcattaatattcatctccctattttaacattcttaggttgctccttcttgatttacttagttaaagtttcctattacagcagttctcaaagtgtgctccacagaccatctgagtccctaagaccctttcactgggtttatgagatcgaaactattttcatgtaatactccgacgctatctgccttttttacggtgttgacatttgctctaatggcgcaaaggcaatgatggataaaactgctggcttctcagcatgaatcaaggtggtcacgccaagctatgctggtcatgctattactcattgtcatatatttggatatttggagggtttttttttttttaagaagtacagtgttacttgagtttattttattttattttttatttttgagacagagtctcactctgtcgccaggctggagtgcagtggtgcagtctcggctcactgcaacctccgcctcccgggttcaagtgattctcctgcctcatcctcctgagtagctgtgactacaggtgcccgccaccatgcctggctaatttctttgtatttttgtagacacggggtttcaccatgttggccaggatggtctcgtgatccactggcctcagcctcccaaagtgctaggattacaggtgtgagtcactgcgcccagcctacttgagtttatttgatgaggcagtgaaaataattttattgaatcaaaaaatgtatgttgacatgtgaagtacttgggtggcataggatggtcagttgcattagttgcaagctctactagcctttccccctctgccagtagaatacatttttacttgaaggaataacaaaccaacaaactatggttattgagaagtaggtattatgaagacattttctcaaaaggaatgaaagtttgccacttaaaggaaaataactaatggttattttcctttggtttgtttattaatcataaaattttggcctagcatgatggtacatgcctttagtccaaaccatttgggaggctgaggcaggaggatcactcaagtctggggaagttccagaccaacctgggcaatataacaagaccctgtctcaaaaaaaaaaaaaaaaaaaaaaaaaaaaaaaccaccataaaattttgagctttcaattaaaagataaaattttgaaaacttgattctactaccatgggcttgaaagctttccaatactaaaatatttttctggtaagatttgtggtgatattaacaaatgtgattttttgatactatattatggaatgggtcaacgtctggaagatacagataactcagtaaaccagtattttccaaatgacctttgcattatgttacaaaatcttgcaacataagatccatacaaagtacaaggtagcctaattgattttagtacaatgtgataccaaaagtttattaatatatttaatagtttcagattgctcatttcagtgaaattttaagaaactaccacttgttgatttttagtgtagtttctaagaacagtgtacacagttatctgaatactcctattcaaatactcctccatattccaactacttgtctttatgaggctgggttttctttagatatctcaacggaaaccacatatccagacataagccacataaccaaaataatataagcaactcattaaagagatttgtgggctggggatggtggctcacacctgtaatcccagcactttggcaggccaatttgggaggatcacttggggccaggggttcacggtcatgccttccaagatcatgccacggcactccagcctgagtgacaaagtaagaccctgactcaaaaaaaaaaaaaaaaaagagagagatttgtgaaaatgtaaaacagcaatgccacttttcttactaattttttgtttagaaaataattacatttcatacaatatttatgccaacatgtgatgggtttattattttaaaataaataaatgcatctatattttaaagttttcatttaatttctagtatggtgactatcaataggtatatagtgtatttacggttgctcttatgccagagcaaccagtccagactggagcagatcaggagaccctgggaaagaactcttcagaaagatggaatgattcttataactcctatgctggaacatttcgagagcagagttacagaacaagaaggagagttttggatggaattcccaataaatacatagaaaacaaagcaaattgaaaaaaaaaaaaagataaaaaaattgaaccatgaaggaagagctctctggggctctccgtaatgtttaagattatgaagagctcctgaaacgaaagagtttgagaatcaccggccttcggcgtaattacgaaacatgaaggggtagttctctttcgccaccacccaccccaatcctacgccacagaaatattcacttcttgtcttcccattgccctaacaatttgttatgatttgggttggatcaatattctatattatgatttatgtaaaggttatataaaaatattactctgagtacatagaggctgtttgcagctgagctgtgtaatgtggcttttcatttaaatgtacaaaagggatacattttttgataccttggatctgaaatatctctctaatttgccttaacacttgatggttggtttttggcttgatattagagttctaggttagatgtcattttcctcagaattgtgaaggcatttctctatggtcttagagcttctgatgttgctgttgaaaagtctgaatctggatcatttatgtaacacatctccctctcccttcccctttccctgcccgttcctctcctgaagcctgtctctttagtgttgagaaatgtcacagggatgtcttttggcgtggagctaatggcatcctttgtgctggcacttggcagtcctttcggtgtacaaattcatgttggcctgttctatgaaatattctttaattattttttaacactgtttttcctttcattttcttttttattgtttttgtaactcctattatttggtgttattgtctagtttaaaaattttggggggctgggtgcggtagctcatgcttgtaatcccagcacattgggaggtcatagtgggtggatcacctgaggtcaggagttcgggaccagcctggccaacatagtgaaaccccgcctctactaaagatacaaaaattagctgggcgtgatggcagatgcctgtaatcctagctactcgggaggctgaggcaggagaatctcttaaacccaggaggcagaggctgcagtgagccaagatcccgccactgcactccagcctgggcaacagagtgaaactctgtcttaaaagaaagaaaaaaaaaatttgtcttttctttcctatttgtcaaactttgtaaaaacttcatcttgtaaataattggttgagatgttcttttctgctgtaataattttaatttccaagagcttctctttgttgttactttgtctctgcatcttccttttttatggcattctgttcttgcttcatggatgcaatattttcattgatctctcagaatgtttgatacttggttttgtttcattctgtttcacttttattcttcctgtattgtttctccttccgcaaagatggcttctgttgttttgttttcttctcttttgtatcatatgttttcctcaaatatttggtgatccttggctgactgattgtaatttgggagtgagacgcagaataactcaaggaggagcatggaagggattggtgagtgtggtcttacctgtgtggtgacttgaagaagccattttcttccgtttctttaggtcttttcttttgagttgttgagatctcccaggaaagactcttctaatttccagcttgctgagtgtaaattttggctgccaggttttgggagctaagaggaagaagacaagggagatttcaaatttagtgtgtaaactttgactcagcccccttgtttttggtttcctgcttctaactgaacctagtgtgttctagcctagatgccctgggtgttattctctccaagaacaaacctttaatctctgccagatggggaggtacagtcacccagctacctgggggaggggaaggggtcagggattcgaactgcttcttaaacagaattgcaatcagtccccttggacttagctccaccgttgtcctcactgcctgcaatatctggggccaccaactcttgagccttttgggggttttgaggtctgaacggtgttgtttgcagctttgcctatcactagcttgagactcatctttggatctgctaagtcagttactgctcacctgtcttggctccagctgttaaaatcctgttgcagtttcttcctctcccattttctctgtcgtcgtgagtttctgccatcttaaaaattctttattgtcattttattagggtttcaggagagagcagtgctccatgcatgtatttaatccactaactttaaccagaagtatttttttaaacatttggaaagcaggctgcgtgccgtgactaatgcctgtaatcctagcattttaggaggccaaggcaggcagatcacctgaggtcaggagttcaagacaaacctggccaacatggtgaaatcccatctgtactaaaaatataaaaattaaccaggcgtggtggcacaggcctgtagtctcagttacttggaaggctgaggcaggagaattgcttgaaccagggaggcagaggttgcacagagccaagattgcaccactgcactccagcctgggcagcagagcaagactctgtctcaagaaataaaaaataaaaatataaaaatataaagcattaaaaagtaccttcaagtttttttctttctttttttttttttttttttgagatggagtttcactcttgttgcccgggctagagtgcaatggcacgatctcggctcaccgcagtctccacctcccaggttcaagtgagtctcctgcctcagcctcccgagtagctgatattacaggtgctcgccaccacgcctggctaattttttgtatttatagtagagatgggatttcaccatcttggccaggctggtttcgaactcctgacctcaggtgatcacaccctccttggcctcccaaagtgctaggattacaggactgagccatcacgcccagccaaggtgttttcttagtaggtgaaattactgagttagaagcatttattcaggacctactccttcttaaacaaagtcattgttttgtttcttcattcgcctatgtctgcaatattatagagctagttcaaaagtaagcagtttgattttggctccaacattgagcaatcataatgtaatactaggttcaaatgtgagtagatttgagtgcatgtcgatgttgaaaataaactcactattggagtgttttaggatgctctggctttccaggatggatattacttaggagtaggttggctctgggttttttcctgggttcttgatttgcttgatttggttcttatataatctattctttctttccctttccttctccagaaacagctcaaattatgaaataactttcaaaaacaagttaggtggtagtagtggaggtagtgaaggaaaacagggaactttcctgttcgctgcagagcaaaccaggtgccacgtagaccttctcagatgccactactggacgcagccctctagacctgaaggtatgctggatagacccggatagacccggcggggtgctgagcccaagcgtgtgccagggtgggaggatttacacttcagaaactggcagatgctatgaaatcagaaccttttttcctggcaagctggtatttaaatcttaaccagcatgcttctgtctagacctgactttactcttggggcaatctgatataccccccaaagtgtcataatcacgtcagcctacccgtatgacattgtatttattcactgcactgtgagctccagggagtccaggtgatagaataggcaaagggcaaaatttggagccagacagcctgacatttacatccttccttggctacttctagctctgtgacctttggcaaacctctgaaagcctcggcttcagtttcttaatctgtagaacagggggggaaatttcttcctagcgatggtgttgtaaaaaattcacaactgtggcagcctctgctctcccaaaaccatgtcctctagaaaatcctggctttatggagtaggttcctctgtggcctgtttctgtttggcagcaggcttgtgacgtctttgcttagggtccttatttttataacagaatactgactttttgtttatatggtttccaaaatttatgaagccactaatcaaaaacatgggatcagtgtacttcagactcttacaagggaatataatgttagacagacttctctccggtgctccaaatcccacaagaggaacagttttgttaaggggcagtcatttaaaggatgactcacaaattatctgtctattctaagttatacctttgaataaaattaaaataccaaataaaatatgtatgcattgggacaacatcaacataatcatttttataatcactcaaaactgtgtcttaatcatatggcttcaaacctttattgcaaattattataagaaatgctgtctctactaaaagtacaaaaattagccaggagtggtgacaggcgcctgtaatcccagctactcaggaggctgaggcaggagaatcgcttgaacccgggagacagaggttgcagtgagctgagatggcgccactgcattcctgggcaacgacaacagtgaaactccatctcaaaaaaaaaacaaaaaacaaaaaaaaaacaacaactatttgacttttgctttagcgtctgctatgaaccatgaatatagatgccaattatccattacatggttcagttttcctggcttacactgccctacacaagacatctgtccttgacacagggactaaccttgtctctcctaaggaattagtcatttttatcctcttagtaaggagttgtgaaatacatgatgtttccctatgcacctccgtgccaggaatgttagaatcaagttttgttatcaatcataagaactgtctaagattttcatttgacatgctacatttctactcctttttttttttttttggaaagggtttcactttgttgcccaggctggagtgcagtggcacaatcacagctcactgtagcctctaccaccctaggctcaagcaatcctcacaccacagcctcccgagtagctgggactataggcatgcgccaccacgcccagctaatttttgtattttttgtacagataggagttttgccacactgcccaggctggtagatttctcctcttgatcctgttttccacatgttcatttttttttttctttttttgagacagagtttcactcttattgcccaggctggggtgcaatggcatgatcccagtttaccgcatcctccacttcctgggttcaagcaattctcctgcctcagcctcccaagtagctgggattacaggcatgcaccaccacacccagctaatttttgtattattagtagaaatggtgtttcaccatgttggtcaggctggtatcgaactcccgacctcaggtgatccaccctcctccgcctcccaaagtgctgggattacaggcatgatccactgcgcctggcccacatgttcatttctagcttgttaactttattgtatttaccatactctcccactttttaaactacagattccttgtagaaaaatgaataaatgaatgaatgagtgaaggaaagtcagtggcaataactaatgatgtttttaaaattgtgtagtaagtggcatagttatgagatttgggggatttggggctggatcagacagagaaaacagaaggggaacatgccagtgtcttcaaatgtttgagacactgtagtttggaagagacagcggacatgatttttattgctcctgagaatagaataggagccaatgaatagactatccattaattgatttgttcatttctaagttatttcttatgcacctgctctctagggcatgtggacgaggtccagatgaggacaagtttcctgctctcaaatttcttgcattttagggaagtaatttttggctgacttgcaaagaactttctaatgagaagagttatataaccatgggatgtgttgccttgtgaagtagggagctttccatctttggagaatctcaaaaagggctgaatgaataccctgaaaaatactactccctcgggagagaaggtggatttgttgacctctagggtttggctctactgtgcttccatgtttctcttttatttgtcagtttccatcttaaactgaaggattaggtcatttcagggagttctggaggtgaggtggtgggaagcaataaaaataccttcacaaaccagttcctttactctttgatccaggtggttcccacaggtcccttgacccccgataaagtaatcccggctgcctgcgacggaggtgtaggcagccagggttcatggagcctgtggttatctccttacagagagccttatcagcttgtggagccaccgtaaagcttgctttgacctttggcagagactcctcctgtatgtctgtccacagaaatgagagcaggtgacagacacctgggatgatcctgagacccagcacccaaagcccaggcttctttctatggggaagtcaagcagagggacccaagctcatagccagtggaggggtgggttgatgagaggcgagccctttaccagatgtgagcccagtcatcactctgcattttctacgcaaaagtccaggggcttgctattgaaattaggcaaagaggacaaagaattgccctctgtaaagtcctcaaaaaattataaattataatttttataaaatgatagaattctaaaataaaatttttataaaattataaattttatatatatataatttcctggaaataacttacagaaaagttgcaagaataaaaatagtacaaaggacacccttattcactgtactccgttagcaattaactattttttctggaccatttgtgagtaagatgcgtataccattagcctttatcctgaagctcttcgatgcatatttcctgggaaatgagatatgctgtcacgtagccagagtacacttatcagcttcagtaaaattaacattgatgagtacccttatggaatctatcatgcatgttccaatttgttttcagttgacctgataatgtcctttacagcattgtctccctccagtgaggggtccagtctaggatcagattgcatttcgttgtcgtgtctctttttgagggtcttttaactgtaccattattattgttatctgtcatcttattagcttattcaaagttgttagaggtatttcttatttagggtacatctcatttacaatcatcctttcgttcacttgaaaatgaaggctaggttctctggagtccagactcactccccttctatgtgaagtgttttcctgtgtatggtggaagggatgggggtgagaaattttggatgtacattatgtacatggttgacttttctttgtttgatttaaatcatacaaaaacagatcagatcctttgagatcattttcaaattccgctgttgtcaatccgacttattgccaaggagatcgtcccttcatccttgaggaggaagaaaggatcattttgagaatcttcgtttcatatcaagacaacacactcttctgaatctagaaacagaaatacctttacatttacttacagcccttatctcagcactttcatgcatcttatgagaagcaacacgcatgataattaagcatttctatgcatgcagagctttggttagcttggtaaagggtatgttcagcaattctggtccctgccctccagaaaaacttgcttaagatgcaccaatatgcattattaaatataataacacatcaagtaaaaactatgcctaacactcgcaggctatcatacagacttagaattattgagatgatttttcagatggtaacatttaatcacagagaagctgaataatttgccgaagtttactttaaaaaaaatcagagctacgataccaatgttcagtacctttctttcttagtataatcccctactttcaaaataacctttatagatatttctagtatctacgctaagaaaaagagtaatggtgaaagactgagagaagacactgctttttaaaggctatagaaatctggtacatggcttctttgaagaaaaaaaattaaatggaaggaaaattggctgctcattttctgagggtgcaattttatatagaagatatttcactgtggtctgtatttaacaagctgcggggaccctaaggctggtagatggtcagactggtaacattttctaatgtgactctgataattttgacataggctttctttttggctgccctaagtatttatccttttcacctgatttactttacattcgcctattttaccatgggttacagacaagaacaaattggactcttaaaatggcatataattttaatattttctgagtttctagtattctaaattcataattataacctgagggatgtatgcccacagggcataaaacaatcacatagatagtgagttttttttttttttttttgaaattaccttggctacttgaggattctctacacccctgctatccagcatgggggccaccagccacatggggctactgagcattgagacgtggctagtctgaactgaatgtgactggtctgtataaaatacatattagagttcaaagacttggtacattaaaaagaatgtaaaatatctcattagtagacttttttatattgattacatgttgaaatgataatattttggatatgcagggttaaatgaaatgttattaaagttaatttcacctgtttctttttaattttttgatgtggctactagaaaaccccaaattccatatgtggtttgcatttgtggctcccattatatttctgttggaaagctcagctctagaaggaaagaaaatacataaaaaaagaccaaaaaaaacccaactcattcagtgtattttagagtgaattacggaagggaaagctgaatagccaatgatcccattttttttcttgattaggtttggagttcattaaagcttctttaattaaatatattgtaaatctgcttcaagttcccagttgagatgagaattgaatctttttgtttaattttaaaaattctaagaaaatcctgaactcacttcaaaagcgacttgttttttgaaatctttgtaaaaagctttccatttacatggattggaggtctgattaatatagagttttgaaggggctaaagaggtgtgaaaattatccagaaacttctgaaaggacctttcttatctcacaggcatccagggagacataagggcccttagaagccgcagatcagccataagcatctgtgttcacagtttccttccaataagcaaaaacactgggagagataacatatttattcctaggtgtctataactgaatttatgggtgtaacttgctggatattattgcccttgtaaacccatgtaactgcacacgtaaagcatgtttttattagttcctacataaaatttttatgataatggcaaacaaaggaccaatttagtttagctgagtttgttcttattactccagcttccaatagataagcaacagtgcaaacagcaggctgggcgcggtggctcacgcctgtaatcccagcagtttgggaggccgaggcgggcggattgcttgaggtcaggagttcgagaccagcctggccaacatggtgaaaccccatctctagtaaaaatacaaaaaattatctgggcgtggtggcacatgcctataatcccagctactcaggaggctgaggcatgagaattgcttgaactcgggaggcggaggttgcagtgagcctagatagagccattgcactccagcctgggagacagagcgagattccatctccaaacaaacaaacaaacaaagaaacacacacacacaaaaacaccaccaaaaaaaacccccgaaacagcaacaacaacaacaaaaaaaacaccccactgcaaatagcagcagtcaacagggaagagagagtcagtgcttgcagggctggggctcctggcctgtgggtaaggaggattgaggctcccctaggcctcatgggactgcagtagggtgaggctgggctggcctgccctcagcttgcaagcctgttgttgagcagctgttctccacgttggtagctgtggagtattctaatttagcttctgaaaaggcttgcatagctagtattgaaagaactcccacttactgtatttcagctggagaattacagagaaaaaaggttcaagtggcttattgtaggtcatctcccactctgggatttaaacaaagcacaaacagaacaaagttcctttaaactgggtgccttcatctgagtccctcctgtctgcaaggtttggcaggctcgctggatacagagcccacgcctctcattctcactgctgcctttttatgtttgacccttggatgtggccaacgattcccatggtgacctggattggagggaagtttttctagaatttgaagataaagcatctttcataaatactgcctgttccttcccaatgactagttaaaaattgatagtctgtaaactagagtgagtgcgatccgtgaacccaaattcaggagacagagtttgacgtgtctaaatgtacgcaggggacaatagcaagaaatattttaagctgaatgagcctgaaatataaaagacataggattgttatagatatgtcatactgaaggctgccttggatggaaaatcaactgaaaaaagggcaagcttagtacacactaggtttattctgggctaaggccggtctaggacattcatgaaattacaacttagtgattaggggctatagtggtttagattctagactttagaagtatttacacatcaaaaaactcatggctgcgaagagttttcctcctagcatctgacacaactcctcattttgtaagtctgtactggagtgaattctagacagctggcttgttgtatttatttttatttttagaaatggggtctcactctgttgcccatgctggagtgcagaggtgcaatcgtagctcactgtggccttgaactcctgggctcaaatgatcctcctgcctcagcctccccagtagctgggactacaggtgtgcaccaccatgtctggctaatttttaaaaaaattttttgtagagatggggtcttgctatgctgcccaggctggacttgaactcctaggctcaagtgatcctcctgcctcagcctcccaagtagttgggactacagggacacaccaccctgccgagcttgactagttatattgttcttaaaggtttatagaaggaaggagcttctgtagcctccaaccccatttttcggatgcgttcctttaaggactaatccaatttgaggttctttattctatttcctcagtgggcatgtttactgatcctcaaatgtgcctttatatatttcataagctgtttctttgcattctttcccccaaaggagtagtttccattctttctgaaaaacactgcttgagcctcgtcccttttggaagagcagttctggggtgtgtgtgtgtgcgcgcgcatgtgtgtgtgtccacgtgcatgcgtgtgtgtgcatggggggtgtgtgtctgcatgcctgtgtgtgtccacgtgtgtgtgtttctttggcctcctctcaggctctgggggaaaaaaacctctactaaatcttaagctaagtacaaaatgtgtgcatgtttcactcttgccaacgttttagacttctggtgttaagccctgtggaaatgcaaatagcatagtttttaatacttactctaagggtactatttagggaagtaaaagttactctaaaggcaagattgatttcctgccctcatggaactgacctttcataatagatagcttgttgtccatgctaacaagggcttactacaagtgctacgtattctcaatttgtatcaaaaattgtagtttggggccactggcttctttttggagatggcctgattgattccagactctggatctgagaagctgacggttttgtaccattgccctacacacatggaaacactgcagacttcaaagttcctttgttttaagtgcggtggaatcatagttgaggggacagtgaaggaagaggacagactgagctgaggtgttgttgctgctttctctcaaaaggttgttaagagatcattcatttttgaggaattgcaacaagactgatttttttttttttttataaagcgtagagtcttttaactcaggattagatgaatagcttttcaaatgtgtatgaaagacaagaatcccaaaagattggctctattttaaatagcagactccagggactcaaggtttgtaacaaaagggcagatatggaagagatgaactcccgggtccaactctgagaatagagcaccctcagggctggggatccctgaggtgtcagggaatgccaatctcgctggttccggtttattagctcggggaatctcgttagatatcctcacaataagctagttggtattgactttgcctgacccatattataaagttctaacaagtggaaagtatagccaagctttgggaaatgccatagcatgcagaatagaagagaaaaccagcgtcttaaatgaacagaggagaaatttgagcagaaccaccaactggagaaattaggacactggctggaatgttacagccacaacaggggaaaaaagcagaatatttacttagtgaagacataatgagatggtacaattctctggtgtcaactttcacagaagagctttgtctctgtgctaatgatgcagagagcagggaagtgatgagaaaattgtatagacctcaagaaatccaacaacagcaaaaaaagaatttggagtttagttttgtatcttctgaggtccaggatttttccatctccctaaatttgagaattcaggttcaaggaaggacttggagaatagtcaaaacattactacacttcttaaagcattcttaatggtatttttactagtgaaatagaaaatgaaaacacacacatgtaaataagcatattttattaatcctccaaatgccctgggtaaaccagtttagaaaaccatcagatgcaaagtctgtcatgggtctggtgacgagattaggatcagtcctaattaggattaatgaaacagagtttcccgggaagcaactgtgacaagctgttctttgaattctggacatgtaggaatgatgtgaaagtctagatgatcagcctcatggagtaagggatccgaacctccaaagggaataggcagaagaacaatttcaaatatcttcataagatcagcccacaaatgtttgcctacccgtgtgcaggtttgcaattagaggctttagagcattggttttgattcttaagccatttttatttgaggagaaagatgcctgagagtgtttttagttaatattccttatggcaaatctgtgattttgcaactaggatgcagagaggttaattgactttattaaggtcccacagctggtcatttgggtagaactgagcccctggcttatggctaacctacagagactctccctctctgtatttctaggattttcagtcatttcagagttctgctgtcctattgatgttgttttttttttttgtatgcatgaataagtgctgcaattaacgggctgtggcgtgaactaggggtgtgaatcaggatcactcatcccaccaagttgggcttctgtgtcttcatgtttccacatggaacttggcctggaatagatctaagggcttttccagctccatttttaaaaattgcttactgaattgtgtaggatttggtatttctgcagttggcaaacagaatacaaggtttggtgtcaagtcgaaactggaaccatgtaagccattgcattactctggaacaatcagctgactctgaaacaattcttgttcaccaatgacagtttgggaattttttcccagtttggtagggaatttcttttttgtcatttttgatatgtttgtatgtttttgcacaaaggccactcaaaggttaagtcggggcattttttagagatgtaatgggaatatctgtaaatggtcctgctttagactggattatgactttaggaagcacagggcacgttcagccgcatggccctccagtcatcctatgtgcagtctcacacgttccccactctggggaaattgaggcaaagagaggggagatgagtcgcccatagcctcccttgttgctcccaccaagccaggcccagaattagttcctaacacttaatgtaacgtttaccaggggcctgatgcctgacacaccctttgctaggcactaggattacagtgacaagttaatttggtccagcctgtctccaatttgggcatctccttcgtggctgtggtatggagtggctcagggtataatgcactgctggttgccttgaaagtttcccaagcattagccaagacttaggtgaagaacttggacatggaggtgacgtaggccctgggaagggactgcctaaagatgtatgttcatgggctccacagacaagaaagacatggcagattaaacatggatagaaaagggcatgatgtgtattagaattaaatgctgcagcagttccagctaatctaatttcagtctcttaatctcattgtctttccccttggcagcataactaataaacaatgccactctgcaacagttacataaagcacgtattcaatagtcaaaaattccaagctcttttcttcaaaggttaggtctattttttattttattttattacttattattatttttttgagacagagtcttgccctgtcacccaggctggagtgtagtggtgcgatctcggctcactgcagcttctgcctcccgggttcaagtgattcttctgcctcagcctcctgagtagctgggactacaggtgcgcaccaccacgcctggctaatttttgtatttttagtagagacaaggttttaccatgttggccaggctggtcttgaacccctgacctcaagtgatctgcctgccttggcctcccaaagtgctgggatgacaggtgtaagccactgtgcccggcccaggtctattttttaaatggataaaagaaagagggtggctcaattttgtgacagggtctttaaatttgtcagtttgtgcatttcatcttctggtgccccagagctctgagtgtagctgaaactcatgcccggtatggggaagaaccggggcagggtggggccctttagcctctgggtttggtttctcctctcctggaacctgtattcctatgattacttgccccatattccagagaattccagctctgcagctgtggctgtcgcatctcacactcaaactgactgagatgaacaattactggttttctctccccgcttcccatctctttgtgtacattgctttttgtttttctcttttttcttccttctcccatttctctctttttctttttgttcttttttctctctttgttccttgtttgccctttcttccccgaatccagcaatttgtcttactaccactatattgaattatgtataagccgaagcatcttagttcattcaataaagctttctgtaccctattcaccatgttaaaaatcaagtgaaaacaaagttttatcccttaaaaacaaacaaaactccaacaaccccaacccaactaaattaagtccattcctatttgtatacatctgttaattaatgtatgaattaatgtatttattagataaattccatatccagacacatcctatactggtaatactaaggagaacagacacagtccctaaggtcctaaggttgactatttacttggggagagagactgacaacaggcagttacaaagcaagacatgctgtaggccctgggattgcatggacagtgtccactgtcagtggagtcctgtggagggggtggcgctgatcattcagtgcggggaacaagtggtcaagacatgcttcctggggcactggctcttggttgactatttgggagtgagaaacagtggtagcctttgcccaatagaagagccgcccccaggtgattctgtacataggagctggcctaggagtagcctctggcctgaccctgacatcagggttgagttgattagggttgtgattccatcttgactactcagtctgaatttgctgagttgcaaattgaaagtgaaatcaattacatccagattcagaccatttgattttattttcatttgatcataaacatcacaaaacacgggatagagagagcctattgtgctcagttattcaaataatcctaattatgatcactcattcaaatgattcttaaatgattctttttttttttttttttttttttgaaacacagtcttgctctgtcacctaggctggagtgcagtggtgcgatctcagctcactgcaacctccgcctcctgggttcaagcaatcctcctgtctcagcctcctgagtagctgggcttataggcacacgccaccatgcctggctaatttttgtatttttagtagagacggggtttcaccatattggtcaggctggtcttgaactcctgacctcaggtgatccacccgcctcggcctcccaaagtgttggaattaccagcgtgagccaccgcgtccggccccaaatgattcttttttttaaaatacaatcttttgctgttagcacattttctgaagagggtggctctacttgagccgtacattctctggatgatgtgggcctgagctgcccaatatgaactcaagagtagcgagaaaccaagcccacaggccttatctgctccagggcttttccacctggcagacggaattgaagctcttactcgatcgcagttgtgcctgcttcacagggttgttgtcagtattaaatgtgtcaatacaaataaagctctcagaacagaagcccgctcatggtaagtgctcaaaagtggcaatggtgataatgatgatctatgagcccacctgtttcacatcctcaaaggcctctgaggctgaagctgatctcatcatgtcaactggactccttgtttcattatacaccctgactatgtcgctgaaaacaccccccaaaacatcactgaggaataagtattgagatccagcatacctgcaaggtgaattcacatgcatatgtgcaaaactgcaagcttcatggtgggaccatatcacctcttctaggagactctttttaaaaagcttgatctctatcttaagccacacatgttggaactaagaaatctaagggaggaaccccagatagagatgcagttggccctttgctgaatctcggtccttcctggagcaggcgggcagccctgcccctttatcttctggcaatacaaaggataaaagaaaacagttatcaggtgctgaggggccagatctgagccccgataatgggaatcctgaaacatgagcagcctcttctgtttgcagagtctcatcatgcaaggcagagtgctggaggtagggctataaattgagggtgaaggaaaggcagccctcctaggccctgcgtatcgccagttgtggaattctcttttgcaagaggtcactgagtcaaatgctgtggatggataattttatggccactaataaaatttatagccaaagcaagctaagataataagagtaatcaaacgtccagccctgggacataagaatcccatcctggcctggggtgctggctgggggtgctggacagcacagagaggagtttatctgtctgactcaaggccagcctcagagtctcagaggtgatttgtgtccacatgaactgcgaggactaggccaggtctggggcaagcttcagcttgggcagtaactgctgtttctctgcagacagcatgccaacagcagcaggaaaaagctatatcctatttaaatgcctaaaagcaaatcgtgagcctaagaaaagatctgaaccaccccagctctggaatactacattatggaaggaatgctaactggtcattcacgtgtgacttgccaggtgtgagggaagataaagaaggatgcaagtattactcatgcaagtataaagaaatcagatgacgtttaaccaaagagttgggtttgtgtgggggctttcccctgcccatctcctccctcttctccgagcttagctcctctctgagtttccttcccatcccagttcttcctcctgtaggcctggggcataggcaaagtgggatcttgtcactgaggccaccctgcagaacacacctcgtgacatctatagaggcatatcagtcactggaagacagaaaccctgggttcttggccctcttctcttgactcgggcctcaccgttgatggtccttatgaccacactctctaaaatggcacagcaggtaggtagccacgtggaacaagttgagaacaagtaacactctggtgttgtgggattctctctctctctctcttattttttgagacagggtctcgctctgtcacccaagctggagtgcagtggcacaatcatagctcactgtagcccccaaccacccaagctcaagagatcctcccacctcagcctcccgagtagctggaattacaggcgcgtgccaccatgcctgcctaatttttgtatttttggtagagacagggtttcaccatgttacccagcctggtcttgaactcctgagctcaagcaatctgtctgcctcggccccccaaaggcttgagccaccccacctggccttctttctttttttattgtggtaaaatatatataacctaaaatttaccatcttcaccatttttaagcatgcagttctgtgacattaagtatattcacattgttacacaaccatcaccaccatctaccaccaaaagaactttttcatcttcccaaactgtaactctgcccccgttaacaataactctatgaatttgactattttaggtacttcagataggtggaatcatacaatatttgctcttctgtattatttttaaataaaaactcttttgatgagataggtcagagaaaatccattttattgccctagtttttagtacattttattcaaacaagaacccagcaatagttaacttgctgcaatgtctactgagacgtctaaaccaaaacatgtcttgctgatgccagcttttgccctcttcacaaatcctgcttaggaaaggttcatgacactgccacagtaggcctgaccctgccagggaaaggcatcaccgcggttctgggtagctctggtgtgcgcgaagaaaagagacaagcagggtgagagtgaagtctaaatggatcaacaagtttgcctgataccttggagtcaggaagcacgggaagaaagagttgagtggaatagcttagtgaggtctgaggcctgcctgatccagaggagacactgacaaacacagacgctgcagaagaggaagccgtcccaggttaggaggcatcccagtgcttccctcctcagtgagtcatttcatctgtttctctgcctgcaaggaagaaataaacataactcataaaatgaagcatttcacctcgccgggggagtggcattgaagtgagaggcatgcatctgtgggtgtcagagcaagagtcctctgtagctgcttgtccttgacctggaaggaagggtctggtggggtgacaaagtgacatctgctccttagagggagcctgttcttggagacccctctgccagatacatttttatagtcagctccagaagtgacttgatgtggggattgagacatattcctgcagtcaaagactcatacatagaaagggacataatttttttttctttctctctcttatgagcaaagactgaataaggcttatgtggactctatcactgcatcgtgatgactggagtaaggtgccctccgtccatcatcgtcagctttctattctgtgtctgactgcagtggaacatcggcgtgatcaactctacattatttaactttgatccgggcgtgcattgtttgatcttttcctttgcagattgactttcataatttatattttatagaatacacagaaatgtattctggcatattctaagagcataacggctgacagcatagacacatcctaagacaatactaagggtttacaaattagctgtggatggtcttttccaagataattgtgagttgatttgtgctaacctggatcagaaatatttatcaagcactcactgtttacaaaactataaaagcattaagtaacagtgtaagtagcagatagcaataaaagatgtcccaaggcagtgagatattaattgtgtaagagaaaatgttattaaatgttattttctgggatttgaggagggggagcctgtcattaaatgtcattaattaaagactgagtaggaagcaattgctctccgtagatgtctctacacaggaaacggatactgtttggtgttccctgctgtcttggcagagtcagagggaggtagctttctgggtcaataatgccgtttaagatgaacgcccatgctgacacactctggtagctctcagagtccttccttcagtgtagaagttaaaggtcagcagcttacagattgcaatttgcattgtggaagcaaccttaggaagagccacacgtcttttatcttgattctgtggtcaagatggtaaccacatttgggattctctctttctttgggattctctctttctttgggaatgagtaccaagctcctcatactgaggtatcagtgtagacatttaaatgtggttgaaagacgtgaattaaaagttaaaatagaaggagaagctttatttcgatgtggcctgtgaaaagcagactttcactgctcgttaatggtgcacggaattctcatggacgttgagaatgtcacatgtacacgcacatgcacacgtgtcgacacctgcgcagacacacatgtgcaccctctccctgcagcctggccccttttgctgccacctgtattcattttcccaccaccccgagggatatgatgtgctgtttggaaagtaacagatatccttaaggagtgaaatggtcccctgtaatcaagatggagagctaaaaacaggtttcaatcagaactaaaccaaataaaatcccgtggtgaaaatttagttccccttaaagcttgtgattaggaccaccccgtgtgttttcggccactgcttttagacggtgacagtgacacatacacgtaacgaagataatgaggcctttccactagcactgtagggttttcaaacatgttagatggatatttggaggttttctcaggaagaatcatgtatctttcacagtatcgcaagagaagaaataaattcctaagagtctaacacgcagatgtaagccatagtcctttaaaaataaggctcttggccaggtgcggtggctcacgcctgtaatcctagcactttgggaggctgaggtggatggatcacaaggtcaggagtttgagaccagcctagtcaatatggtgaaaccctgtctctactaaaaaaatagaaaaattagctgggcatggtggcgtccacctgtaatcccagctactcaggaggctgaggcgggagaatcgcttgaacccggaaggcggaggttgcagtgagccgagattgcaccactgcactccagcctgggtgacagaacaagactccatctcaaaaataaataaataaataacaaaagtaaggctcttgattcagaattatgcagtgaggctcaagtttcaggagaacatcttctaatagtggactgcagggaggggctctgagggcagcctcgagttaggaagtggtcctgaaggggagagtggagggagggagatggaactgaggcctgacatgctgcacagaagccacctcagccgaatggatcagcatcccaaccgtggctcctcctcctactagctgatttcccttggggaaggagctcaacctctctgaccctcagttccctctttggtgaaagggttgaattgtcttggaatccacaggtgaccacctcaggactgcagtgagggatctgtatgcatccagtaaagcctgtccttagctctgtcttgtggctgcccacctggcctgggggccagagatggggctggagaaggggcaggcttcctccgggagctcatccccacacccagtggagttagcgtagccaaggcttccagcagagttttacatccagagtcatctttgttataggtagcagcaagaagcagtctctcctgggaagacttgctttgaagtgtggggagtcgcactgacttgtaggaaaggccactgccttgagatgaaattccaaagccaagaggaaaagtgctgttgaggaggtgggatgggaggtcaactcctcaagtccctcaaggaattcagtggaagccactcctgagaaccggctggaggtgggaagcctgaagaatgagggagttcacggtaggggcctgaggtgcgtgaggcttgtttgtgttggtctgagcagggctgaagccgtgggcccagggcctctttccttcagaaacagtcggaagtgaccaagcttcagctcctcctcctccccaggcctcggcacccaggcccggtgctgcggggctcacgtatgggaactgagaaagggaatatggagtcttccttctaggccccacagaggcctctttgacctcaagacttggctagaaacacattttggaagcttccgcatttccaagtcacagataatatttctacacacacacagacacacgctcttattttagagaagggacagaacatttgtctctggctgactacaagtttctttatctaccttcctttcaaatctcctgaggacagagactaagcaaagtttaccttttgtaatcccccaagtctgtctggtgctcaggttattcagtaaacttcagtaactgaggtcagatggtagaaggaaggggaaaaaaacgggaatcagaggcctgtgtttccagctcaacttccctacttgacggctgagtggctttggaccaatcatcggactcctctcctcgcctctgttttctcatctgtgaagtggaaacaatagccaaccagtctacataacttaatgttgtttccaatgtgccttctatgaggaaggagaggttatcagcagcaaagggatagacacatctgagggcatcccttatgctgttaatgactgtttaattgtcatagaatatggatcactgccattctttgcttgacataaaaacaactcagagacacactgtcaccgtttcagagagcttcagaaagaatttggattggagtgcttctttcatagccagatctcatgtagtaggtcattattttgtttctttgattaataggacaattcggttacaaccgaaggtactgtaaccctgcaaccctagagaggatttgcagggctgaggaagagtaaattcctattagcaagtatcttggtggcaagcaagatggcaccttggtaagaagttatccatccaactcagcactccaaagacctgcataccagtgtatgcgggaaaaaccatagccggtctaacagggaggcgccttctcgctcagaatcatctacaatggatatgattgtaattgttgaagaagctacagctgcttctactgagagcaagcctcgctcttctgtttttcagaattataaaaatggagctaaacagagataatggaagttgcttttggagcactatcttgcagactgtctttgcacaagatattgacaggaaatgtctgcacgtttcttagagcctcctgaatcttcagcatctacttttttttttttttttgcctgacatataccaagcacccaacacatggttgttcatacgaatgaatgaacaaatgaactagtagactaaaaaagaggcagctcttgatccccaaacattgtggagccaaaacactatcctttgacagtgatgaggatgggagaaaagactgtcatatcttaagaattaaacaaaataggccaggcgcggtggctcacgcctgtaatcccagcactttgggaggctgaggtgggcggatcacctgaggtcgggagttcgagatcagcctggctaccatggagaaaccccgtctctagtaaaaatacaaaaaaaaaaaaaaaaagttagccaggcacaggggcgcatgcctgtaatcccagctactctggaggctgaggtaggagaatctcttgaacccggaaggcggaggttgcagtgagctgagatcacgccattgcactccagcctgggcaacaagagcgaaactctgtctcaaaaaaaaaaaaaaaaaaagaatcaaacaaaatagaaaagcaatgaaatgttttaaagaaatgactcttacttaaaagacttaagaaaatttacgtagatacacgtgagcagtagaaagtaagaatagctcagatttatttcacaaacatgttttgagcatctttgtgtgccagccattgtattgaccttggtatacagtggtgagcaaaccagccttagacctagagacctggggcttttgtgtagtgggggaaaatgacttactattaaatgcatgatatgaaccgaagtggagatactgagggaaaagattgaggctctgtaaaagcatccagcagaggaagcataggctggaagaaggcttctcggaggaagtgaggcttgagcttacatctgcaggaaaagtgggagcattccatatggagagcaaaggccccacggcagaaggagcaggaggtgtgtttgaggaccttgcccgaggctggagccctggagtgtgaaactgagggggaggtaaattagcagttcctgtagccaaatcctggtctgttatttctgaaagtctgtcatctctgaagaggatactgggcataaatacaaatgagaacatgatcttttaggtggtgagagtctatagagcaggcatttggagggatgccctctccccattgtggaactagcagaacaaaatctaaagaatgcacaaaagaaaccaaaaaatgagctgttaggttctaaggagggagggagtgtgatggaaagcacaccatgagaaataaggacatggacctgcccccgccccatcatgacactggctgtgtctgaaaaatggagcaggaaaggcagcgtgactaggaaaatgtgcagttttaattttacataatatttgtttttttttagaaaatattttctaagataaaaaatgctaacatttgtgaatagtggtagtggatacatgtgtatgttttattattggatttttttctatatatcacatttttttaattagaaggggaagacttttttttttcttaaattagaagaggggcagttaaaggaaggaggtaggtgctaggaatggtttaagagtcagggtcctattcctagatacaaattggcttgggcaaattgcttctctggtcttcaggtgtcttatctaaggagaagagttttgaagatgatgatgttggaaatcccttctagctctagaacgttctgtgatcctgatttttaaaaacaattgatgattgaatagttctatttataggcttgggaatttggtgtctcatgctcactaatccctgattctttaaaattaggagaaacaatcttgcttggcacaagatagccaatagctttctagtcaggaagctcgtgcattgaaattcatttgcccagagacattttcaaaagctgtgaacccacaggtcgctgacatcccttctggaccagatgtgggaatctggacccacccagaaagctgtgcctctgtgtcaggcatcctgccattcaccacacgcgttccagcggctgctctctggctttgcagggcacctgcaggacagtttgtgcataaggaatcccttccctccaaattttagatgagaaatatggtaatgaaaggaaataacccaggcagagtggcttgtttcacatgtcacggtgtgtcaaaatcagatgtatgtcttagattcttgggggaaaaaaaaagttgtcgcatgaatttgggggttttgttttgtctttggacatggtccgggaggcatgatgcgcgccctggagcttcatcgatgctgttgagtggggatgacggtgtgcatcgccacatcctcagctttccagttgtttcagctgcgccctccaagctgccctgttccgcggggacaatagcagccagtggacgggagcccgcaccacacagcagcaaaggaagccggaggagaggctctgcgggctctctgctccgtcagcaggaatgtcctccgggccagcagctgcctttgcagccacctctccagtttctgtcacttgggtcaagtttccttataatgcgttaaatgaatgagaataagaaagtgtgtgttggcagaatttccgttgaataatgccaaggctttccaagtaagagcatgaatttaagcggagcaaagttcccagtcaatgggattcagagtaatggctattctgctaataatgaaaagtagaaatgtttttacttttaaaggttcacaaatgggctactcttagggctcgctggcctattcagttacaaagtggaaactgttccggatctttgctttattgcacttgtatttagtaggtgattggaaacattttccacttagcatttaagggtttgaatagactggtgactttttttcaactaaagtttcctcttttttaaaaaactgacatttttctttttttgcaagtagactgaagatttcaagtaacaggttttccaaatacttagactctgcctgcataattattatatttgccgtggggattagcacttttcaaaagtgtatttctacacaacatccttgttttgccccaaagtttgattcttcacagcttattacgtagatttaggcaaaatggaccgagctccatccactagaacttccattataaaggcaatcatttcgaatgaaacagaagccatttatcttaatgaaccagcaggaaaatgaagtctgttgaaatgatctgaacccttcaaaaaatattggtaattcattgtggctatatttatttttattagtttctctatgttgcctgttttattgactttccacagcaaaccaccacccccaccagcaccaccaaataccgttgtattttgattccttatgttctttattagcaggcttacttctctcttcatagaactatgcctttgccccactgctccatttcagagcattcggggctattcctggtaagaagccagcattagttaatgttactgttctggtcttgggctgcaaagagtgcatggataatggttcatgttttcccctccaaatggagggaagacacagacataattgaaacttacaatgtcgggggataattttataccattatttttaatgaaaacggggaagtatcctagctaaaatgctggaaaatagccttccagtagccctaagcatccacgtgtaactgaatgcaggtgggatagaaacctgttccctcttgcctccctcccccaaatagagagatgctgtcagtggtcaggaaaagcagtgagccacaggtaatgagctccgtatccattttctttgtcagatctcccagctgatgacagagagtagccgggagggactaacagaagcagtgctgaaccgctacaatgcagacaagccttccgcctgcagtgtcccagcctcgcagggctcctgcgtggccagcgagacttccacaggcacatcggtggccgcctccttctttgcacggtaagagagctgttcagatccttggttctttccgatgagcccagctggttagcccctcacgtggactagctcagctgaaacactagaaagagtttggggccgttctgtgatgtcattcattaagacagagtttctcagccatggcactgtgacctctcgggccagctaactgtggtggggactgtcctgtgtgttatagggtgggctgcagcatccttggcctgtacccctcgatgtgtgcccgcagtaccctcctccagtcgtgactaccaaaaatgtctgcagacattgtgagaggccccagggtcgagagtcgctgctctcttgatgtgtagctccaaagatgctcttttgcagcatcaggactttgtagaggcatccctctggtgggtgtttccagatttatcttctcattacagaaattgaactgcttaaaagctattaaatagatggcaggttttctcccccgcttcttgacagattagccagagtgttatcaaatactctccagctaatcttgggaacttcaaaaatacaagaaacaaaaaagaaaggtatttcaacaatgttttctgcctaattttagcaacatggcagagacggggcgggagacgaaggacagctgagcaggaaaggacttcagggattgtctggttccatctccttatttatgaatgaggaaaccgaggaccaggaaggttcaactaggagtgagtttatagcacagccagaaatagaaaccggattgctctacatttttctgtataactcatgttttaatttaatgctcagaactgaaccttggaaaactttctctgtctaagatttgcaagctcctgagtaaacaggacatagaataaatgcgatagcatcagatacgaaatcacaagaccttttgggttccagttgcagcagttctgcctcagtttcttcatgtataaaatgaggatgatacctgctctgcagggtcgctccgaagactaacataagatgatgagaaattataaagtactgtagaaatggttactactatgtcagtaagaaggaatattgtgtggctttgcttgttatctttatgaatggtaacatccagaacacaaatatggggaaggggctctgattaggacagcggcaaggcagaggaggacagagggctaagaccctggatgatgggaccctaaaggcagcacacagggcttgttggaagaccggctttgagggtcttcattgtattttggtgctgtgtttattgtcgtatgaacacttgggacaacttgaatgtgtgggaagtaataggaaatatgtataggctggccacccaacaatggggaccattgtgttagccctgtctggacatgaatctctgtgttgtcccagaccattaagcagggagtccaagctcactgggaggtcatgtccatgccatttagggagagaataaagacagggaacagttatgaggaaatgtcacaagcacagaagctcctaggaggttattagaacatgttcaaaggaggctgactaagaagccatggcatggcaggttcagtttggagaagagaaggactctggggtacatcatggatgccctcagctatctctcaggctattgtataaatggagacttggttcgttctgtagagcaaccagttatgtaggcaaaggctaaataacgagggaggagacggacctcccagctcagaatgaagaacttgcaattccgatggcttcaggagagagtgagatttgtgtccctaagggagatcaaagttatgttgagtaattacctggcctcgatcctagagggaacattcaatgctcagatgggaattgacttccgacgtgcctttctaacctgaaattctttgaaagtggagtcttccgttcagttccagccagagaattttacagaaggttgactgactcacaaggcaacccagaagatttgaagcaggaagaaataagaagtgagggttcccaattggcagaatttaaggagaacatgagttctccttaaattcttggtgcgaggaaaccagcagcgtctttggagctggggaaaggatgtggaaatgaggggggcctgggaacctcatagtactggacaaggtgtgcctgaggccagaggtcaggatatcagaggaggatttacgaacaagcaaacacacagcagggaaaggaataacaaatcactagcgaaagcctagggtggaagggagatactgaggcaaaacccaaaatgtatgggccagtgatgtcaactggggcaggctctgcaggtgatgctagcagcaaacaaagacttgaaactcatgacttcagaacgacaagggcttgcagtatgagctttcaaagagctggaaaggatccctaaggctccccaaatctttactattactttctgtgcagtgaacgctgatagtacttggagcttcatggtataagcattaaaagtatgtggtttgtattcaaagggtttacaatgtacagtgggaaacaagtaccatgtgaaaaagaacaattctttctatagatttcccccccaccctttactcattaccatattttgccatgttattctcatcattattgatgagaactattattagctgggctttcccacctcccagcgagggaggcagcatattaataacccccctgtcactgaggggcacccaaagcagaagtgtgactgactggctccaggctcatcctgtcaagaggcagaaccagggatgtacctgacagttaggtccccaaacgtccatgtgataagccaaaacctgcccagcttatgctgtcagacagtcaactgagttcaaagagccttttggttttagctgaagcaaagctgtgtaaggggatggtaatgacagcttttgataagtgtctgtcctcataggggtttggggcagagtcagctcctacacctccaatctgtgctcaccactttccactcttcctgcttgactgcaatggagagagagtcctctgagtctgcggggccctggaactctcctatagctccaagtcaagacacaggggtggcctgctttcaggaagctgtcctgggctgggcatggtggctcacgcctgtaatcccagtactttgggagaccaaggtgggtggatcactagagaccaggagttcaagaccagcctggccaacatggtgagaccccgtctctactaaaaatacaaaaattagctgggcatggtggtgcatgtctataatcccagctacttgggaggctaagacatgagaatcacttgaattaggaaggtggggtttcggtgagccgagatggcgccactgcactccagcctgggtgacagagttggactcagtctcaaaaaaaaaaaaaaaaaaggaaagaaagaaagaaagaagcaacagctatgctgggggccatttcgttttatatgggagggatggcatttgctaaatttgtggccaatgtggctgacgtatattgagcactgagtgggcatcactcactattaactacctcttcatatgcaaacccccttcatcttcacagtaaccctgtgaggcagagcctaccattttctctgttttatggataaagaagatggttccctgagttactgacccagagccacatagccgggagtggcggagtgggaaatccatcctcgtttcctctcacttgagaccccaggttcctattctctgtgctaaacagacacaggaagacactttattatagggttttttttttttcaccgtaatcatgaactgatgattgcttataaaacaggtgtgaaactactaggccctgtaatttgtttgagaaggtgagtagaatgacaataacaaaaacaacagaaaaacccccaatttgttgaagatttgaagcaggaagagataagaggtgacacatttgttgttgctcttgaggattcctacctttacacggtgttttcctgttgacgaaaaatatgtctatcctgggtctggaattttctggataaatgttggtgttcatctccatatagcgtcgctctcattcatgcagatgtccacttttctctgtgatattaacctttatttaaaatgtatttatttttattttaaaatcttttttttgagacagaatctcactctattacccaggctggagtgtagtgacgtaatcacagctcactgcagcctcagcctcccgggctcaagcgatcctcccacttcagcctcctgagtagctgggaccacaggaatgcaccactgtgcccagctaatttatttttattttttgaagagatgagtctccctatgtttgttgcgcacgctggtcttgaacacctaggctcaagcaatccttccaccttggcctcccatagtgctgggattatagtcatgagccactgcacctggcctaaaatttattcatttatttatttttgagatggagtcccactcactctgtttcccaggctggagtgcagtggcgcgatctccgctcgctgcaacctctgcctcccaggttcaagtgattctgcctcagcctcccgagtaagattacaggtgtgcaccaccacatcagctaatttttgtatttttagtagagatggggtttcatcatgttgcccaggctggtcttgaactcctgacctcaagtgatccacctgccttggccccccaaagtgctgagtattgttttgattgactaataaacattgtatatatttacggagtaaaatatgttttgaaatatgtacatattgtggaattagcctgtgtttttaaatgcttactttctagaactgtgggtggaggtctgggtgaaccttgttacatttcaaattcaatgcctataaaataagaatttcaattttgaataagcagtgtgtggtctgtgctggtccacacacggttactggtctgtgataagtatagaaatggagaggaagcgtttagaaacatctgctgatggaataattttctgtctgttgaatctaagaataaaaaatcggggcttgcattttgtgtataactagaagtaaaagaaaaattggtccttcacccggatagtttgagatgcactgctatagagaacgatggagcatgaagcacctgttctgtgcttttcttcctctcacgattgtctttaaatggtcagcatcttagtagctgtctttgcttcagaatttcagtaccttccctttttttttcgagaaaagacactgtttctggaaaaaatagtaacagtcacccagaaaagagatcgagacaactgatcgtcaagttggttaactattatgtgctggctttgaacatcaagaacatttcaaacgagggccttttttttttttttgcatgattttcacattaatagaaaatggtgaagtagggtatcattagattttcccatttgctgacagttcactttgaataaaggtggacttaatgatgtactttaccttataaagtatggagtacatgaaacccaataaaaactcttgggtgaaaccctagctttgtaggttgaggcagtggaaccttcatgtatatttgaagagcagttagtggattctggattatgcatagaattgaaccctgaaacagaaaatgaatcttttgggtgacctcatatctttgcattgattttctttcccaaataaccattaaaactcatgggttttgtttttgttttttttgagatggagtctcgctctgtcgcccaggctggagtgcagtggtgcaatctcggctcactgcaagctccacctcccaggttcaagcgattttcctggctcagcctcccgagtagctgggactacaggcgtccaacaccacacccggctaatttttgtatttttagtagagacggggtttcaccgtgttggccaagatggtctcgatctcctgacctcatgatcctcccgcctccgcctctcaaagtgctgggattacaggcgtgagccatggcgcccagctgtgtttttttattcatggagaaaattagcttctgtagaattttcatctacattcagagcaagagtttgaaaaatggtgaaaatggacaaagatcacatgagcacaaagacactgtcaagttttggcagagctggtatcgccagttccatggcgttggtgagcacagagacttccagttctgccctcagacatcacttctaaattgtcatatttttggtgttcagcttttatgtttagttgacagcctttctaccaaattctaatcagatttccaagtaaaattatattaagggcattttttattttccgtgattttatttaaattttcctgttttcttaatataaacaaatacctttccattctgttatctcaggttctgatgacttcagatcagaacttactatcttcaaatcctttattctgtttttttgctcattattgactctgttacattagttagagcttctttctctctctcccccttcctctctctccctccctcctccctcccttctttcctcccttcctgtttttccatctgctcttgaagattcctacctttacacagtgttttcctgttgacgaaaaatatgtctctcctgggtctggaattttctggataaatgttggtgttcatctccatacagcgtcactctcattcctttctctgggatccctgttgtctgctttctcttccacacttgccaagctgtccctcactttctcccactgactcctctaactccttgccgtcggcccaaacacattcctttctcaggacgtgattgtttttctgtccatctcaatctcttgtgtggtatcttccatcgttgtttttgaatggctccctgtgttacctgaacagcattcttcagtcctcttgagcatgtcactgactgttgtatgactgatttgaccagtatccccttgggtccagaggttgccgtagtgttaaaaccaagccccgctcaggccctggggtcagggctaggctgagcagagaggactgacctctggctcccaggccctgccttcaggaccacgtggcttctcttgttagttccctgtggggcctgctcttcgtgctgtgtatcctcatgtgaccatacggagagctgttactggtctgatgaccattattgccgcactctcgctgagaagcaactcagatagcgccttgctgtgatggtttcagcaaatgcttttcatatatgatcttgtatgatgaaggctttctttagtccctgggcccttaacagtggtacttggttatatgtttggagttgatgaagtcagagaaggatgggaaggagcgtggaactgttcctgcttcttttgttcttctgtcaggtacagttccctttagggatgctcccttcttccccttagaaatacatcaacaatattaccagagaaaaactaccctaaacataccacaattggtctcaggtgatctaggcggaggaaaaattgagctgggtgtctgagatccaactcctaggcgtcaattgactgtggagagacagggcacaagttctgcctccagtttcacaacttggaacagttaatgtccagcactgtttccattatgatagaatgatgcctttacaaaaacaaacaggccaggcgtggtggctcacacctgtaatcccagcacttcgggaggccgaggcaggcaggatcacctgaggtcgggagtttgcgaccagcttgaccaacatggagaaaccccgtctctactaaaaatacaaaattagccaggcatggtggtgcacgcctgtaatcccgtctacttgggaggctgaggcaggagaatcacttgaacccgggaggtggaggttgcggtgagccaagatcacgccattgcactccagcctggacagcaagggtgagactctgtctcaaaacaaacaaacaaacaaagaaaaagcccttttaggagctcatattgtagaacttcactgtattatttttttttcctgtttcttgttttgttttcactgaagcatattttgcttacccttagttccttgcacttgccagggtcccgttctgacttggtgtctgttcttttctccttgccccagtgtatcccctcgttctcacattccagatctcagtctgcctattccaggacttcccatggaagcagggctaccattgagcttcctgtgggacacttgtggtcggggccaacatgcataattgtgccatctattcacagaaccagggcgcccaattgtaggagtgagtggggcttaaatccagccaacactgtgccagcctggtggaaccacctcctctggggctctgtcaatcctccttggatgcaggtaatgtctgggctcatgttgtcctggccggccctgcctccttcactggtggccaagcagtgtcaggacatagatctttgaagggctgaactggaaggcaaacccctaccctctggtttcttatttatttatttattcctgacaggtcgtagctttactctgcttagaaaatactccgttgatttcttggaaaagaagggactctcactcatgtatattgatgaagtgaatttttaggaatcatagttctatgaatatggtctcactttaactcaccttatgaaaggaaaacattaagaagcaaccaagggtatatttagtgccatccgatttcaagggccctagaaaacagtctcaggcatttgctgtgtgaagctgaacctcctcagttgcttatgagacagcgaaagcacagaaggaaaagtggttgtaatttaacgtctacactgttttcccttctgctaaaaacatgcctaaaacacctcaaatagataaccctaacatccaatatgcaaccccagcaacccccaactgttctgttgttgggggtgcagtccgtaacagaagtggcattcatagcttggcacacaccactctgagatggtgagctacgctaaagaaaatgaccagcgtttgcggccccttcccatcttctgctgcagggaatgtggtcaggtggagcattttctgattaaacaagtcctttgtctgactggcggccggttggggtgttggcaattggctcccaacatctgggaatcatttccacggctttgcctaggttgaaaactcagttcatgtcttgatgtgaatgtctgaaggcaaagcaatttcaacaagcctcaagaatcccagggattcttgtaagatactctcagggttaaggattctagttcttattgcacattttgcattttttgttttaattgatgctgtggtgggggcgggggtggggggcagtggttaggagagaaggatattgaataagcaaacagaaagctggagaagcccaggcttgaattctcagccagacactgacattctgacttgaggcaagtaacttaaccttgctaagcttccgttgcttctgttcaatggagatcatcatatctgctttataggattatggagaggattaaatgaaaatgtgatagtccttggtaaacttcatccaaatcctacagataatgtgaagatggcacgtgctataaaaaggatggagttctgtcctcaatgaattctcaacgttcccttttgagtagatgacttttcgttgagacctttacaggctgtttaggtggccctttgttatctgtctaacgactgtccaggccttctgtggcaattataaagatctggtatcatgtctctgagaacaaaaaccacctacagaaggagctgaagagcaattcgcccttaaatctcacctgttacgaactagatgccattggtgatggaaaatatcagtgacccatacggagagagaaacctgccctcaagtagctgcattttagcagagctccaggtaggtcactgctcacctctaaatcttctgaagaggtttcatttttttgttggtttttgttttgttttgagttgcagtctcgctctgtctcccagcccagattgcagtggcacaatctcggctcactgcaatctccacctcctgggttcaagcaattcttccacctcagcctcccaagtagctgggattacaggcacctgccaccacacctggctaatttttgtattttttagtagagatggggttttgccatgttggccaggctggtcttggacacctgacctcaggtgatctgcccaccttggcctcccaaagtgctgggattacaagcatgagccactgcacccggccttgttgttgttttatagccctagaaaaactggtaccaaacaataaggaagagactgaagggaaaaaagaagatggggaggggctttaagaattctgttcccatagaactttgtgactcactgaaggccagcaagctggaattgtcgtgatactcacagtggacattaacgaaaacagtgaataaaagtaaaaggggaaatgttctttctttgtgaataccctcgtgatctgaactgggggctgaagagggaggatggggtgacatggagtagattcaggaaaagcagagtagaaacctgtgaactgaaggagaggaccaatggatgaggagaggatgcaattttatctagtatatgttgcgtaaatttgtttcctggtctacacttctaccaccaccctaatacagtaccgctataatatgtttccttccttcagcactgactcatttaaaaatcgtactggccagccaggtggtgccatggctcacaacttgtaatcccagtactttgagaggctgaggtgggaggacagcttgaggccaggagttcaagaccagcctgggcaacatagcaagaccctgtatctggagaaaaatttaaaaaagcaaccaagtgcagtggcacatacctgtaatcctagctacttgcggggctggggcaggaggatcgcttgagcccgggaggttgaggctgcagtgagctacgatctcaccagggcactccagcctaggcgacaagagtgagacccttctcttagaaaaaaaaataatcataatagcctacatttttgagggcttcttatatgccacacactattctgagttcttgacacacatttaatcttcagaagcccccatgagttggccgtgtttttatcccattgtttagacgtggaaactgaagcacagagggcagaagtaagttgaccaagtccacacaactagtaggcaacgcatagggatccgagccaggtgtctgattccagaggccacaagccagaatataagctccaaatataaggtggggacatttgtgtctttgttcttggctgaagctccagcacctaaaagaacactcaagaaatgtttgttgaataactcaatgatggtcttagccaccatgctctcctgcctccaaactcaagatgggttgcaatggacaggggtcattaactaagcagtctcaatgcaacgatctcaatgtgagaccaaagtagagaatgggtacaaagtgcaccacagaagctatagggggaagcttttggaacaactactcttttttttgagacagagtctcgctccgtcgcccaggctggagtgcagtggtgcgatcttggctcactgcaacctctgcttcctgggttcaagcaattctcctgcctcagcctcctgagtagctaggactgcaggcgcccgccaccatgcccagctaatttttttttttttttttgagacagagtcttgcattgtcgcccaggctagggtgcagtggtgcgatctcggctcactgcaacctctgcctcccggcttcaggcgattctcctgcctcagcctcccaagtagctgggattacaggcatccgccaccatgcccagctcattttttctatttttagtagagacagggtttcactatgttggccaggctggtctcaaactcctgaccttgtgatctacccacctcagcctcccaaagtgctgggattacaggcgtgaaccactgcgcccagccaatttttatatttttagtagaaacagggtttcaccatattggccaggctggtcttgaactcctgaccttgtgttccacccaccttggcctcccaaagtcctgggattacaggcgtgagccactgcgcctggcctgaccaactactgtttatgcttctaattttgttagttactaaaatatcgctttcagtctcatgcagtaaaagcaaaaggtttttcagtgacttacaaggctctgtgcacaccatctgtcccctgccctcttcctctgccatgttcccacttgcttactctgctctaggcatattgacctccttgcttttcctctaaaagtgccaaggccattccctccccctaggctttgttcttctgcttggcttaaccagaccttccttcagatctttgctcaaatgccacttccttggtaaagccctctgtgacctccctgtttaaaattacaataatcccacctgtgcacccctccctctcgcgtggtacctgctacattaggaatatttgctgaatgaatgaatctcagacaaatgggagatgggcggctaagtctccagattgtcctgcattgaagtgcttggagaagtttgcgaattttcccactcagttcaaaccacatgctcaggaattaaagtgttctttcagctttcagatgttttcgggggatagcattgtaacaaagcatgaaaaaaagcagtgttgggaaattgagattcttattacagtgggagtacctggttgtcatttcaagatgaggatttgttaagggatgggacaagggatgctgcctgggacaataaaccaaagaaagatttaaaacagagaaaagagttattagttacaggactagcacaaacaaagtagggctctccatctttttcctgtctcgctgaaaacccatcttttcttcccttgaataaacttctttgctttctgtccccctgctttgatttattattttaattctatagctgtcttcgtgaagtatgtaaagcatttgggggtaaaatcatgtggaagacattatagaaactaaagatgtgtgatattatgtggtgttgggtagaggctcagcgtgcttatgaatcacacggttgatgaaaacaccaatctgtccagggccattgtctatcagctgtataagaaattggctcattgttgagggtacaagaaggaggaatgtaagggggactgccggaataattcggttagaattcggtaaaaccggagcatggagaggtctggttgacatccctcctttttatactgagagatgtccctgaaggtgaggtttttattttcttgcctctaaaagggaaataatgaatgtttctatttcttctgtcctattactctgtgatgaatgcttcttttatttttatctgagtctaactccctccaccatacttagcatcatgcttgcatcatatccattaataaatggatgttgaaagaatgaatcaaccatgcttgaaaacttagatctctcttgcttttcaagagactcaaatatttaaaagcagctatggagccgtgtgcggcggctcccgcctgtaatcccagcactttgggaggccgaggcaggtggatcacaaggtcaggagttcaaaaccagcctggccaacatagtgaagccccatctctactaaaaaaaaaaaaaaaattaacagggcgtggtggtgggcacctgtagccccagctacttggaaggctgaggcaggagaatcgcttgaacctgggaggtggaggttgcagtgagccgagattgcgccactgccctccagcctgggtgacacagcaagactctgtctcaaaaaaaaaaaaagaagaagaagaagaagaagaagtaagaagttatgggattgtgcttgcaagcagcacagtttattgtgtagcatcagagttttcatcattccaagtattagtgataaaaataattctgaaggataaatggcatattttccattgttgatttcaacacagttagactcagcagtgcaccatttctgataatcatctatcattttactcagcatatgcaaaaaatgatcttagcatcacatggcaattagatgcttttttttctggcacctggtgtgcttgttcatgaagtgcactgagattccggaaatataatttcaaaagcctagaaataatggcccatgtcattttcttggcattcttcaaaaccaaagccttaagagtccatggtttgtccttttaaaccccagcaacggaaagaaagggccttggcagtgacaaagaaagagaaattctcttgggggtctgtagtgaaaagggatgtaatcagtaccaggcaagccactttgattttttttttaaaaaatgaacaaatataaaccattactcaaaatttctttccagtctttttggtgcttcagaatataaatgtggctcatttttctctaataagtttccatttattatcatagtcatctcttcagtgctcaatcaaagtggcaaggttgtatttgtggagaaaacagaatattttgtaacatggctatcctgaattttagaggcacttactagggatggaaaaactggtctgaagttcttaggcatactcttaccacctaaaagtgttcagcgataaaaataattgctttgtttttacctttgaggaactccaagtatcaggttaaaaattgagagaggtagtgaaagagagtcagtgattccagtgtttcagaaagtctgacctggccagggtccagctgggctgcaagaacctcctttctctccctgtctctgcagctccatcactcaccattctctccaagtcccttgggaatacatggggagaacctagtggccatagcagatactgctggtccccctcttcccccactccttgccacctcatcatttgcttgcacaaaaccttatggttctcaaggcccagcacctgtgactctgcccgagggtttcctctggctgtgggagccccctgcacccacacagggggcaggccacttgggagcaggcccaggtaagactggcaggagttggtggataaacaccccagctctcttgtctctaggtggggataattctgaggcatggtctactctgtctcccatatttccctggcaggattgagccccagttgtctgtgtccataacctgcttgagaacacagactctggtatcttccttccttcccttctcccttcctcactgtcttatggctgttacctagagtcacctcccagttaacctaccagcaccctcatccttgtacaaggatatgtctgagggaacttggtataagatattggaagtatatgctcttttgtccatccatccatccatccatccatccatccatccatccatccatctctccatccacccattcatccatccatccatctctccatccatccatccatccatccatccatccatccatccatctctccatccatccatccatccatctctccatctacccatccatccatccatccatccatccatccatccatccatccacccacccaaccatccaacaagcatttggtaagctcatgctgtatgccaggtattgtgttaggcaccgaggagagcaagaggacagccaccgccctcagggagctctcagtccagcagggcagccagtcccaggataggacagtgagaaaggacatggaggttcaagacagaaaaattcataaagccatccagtatggcttttgctctcccggtgtcttcaggttgtttaaaaattaaaggtggctttccagcacctattattatcagaaatggtcttattggttcacttgcttactagtccattgcctgtctcccttcctagaatgtaagatccatggaaagaggtacttgtctagcttattccatcattgcttcctcaactcttagaacaggggccaggctggcgcatgataaacatttggtaagtgcatctcatagtcattaaggcgtctgctgtggaaagtttgtcagtttcctcctgttcctcccggagtaagctcatccatgttgaaatatacccaagctccactctggatgcagtgttccagtgcactgtggaagtctctgctcaggacaggagggatagcaagtgtgctgcccaccctaggtccgaggtggccacttcctgctagccactgctccttgggaacaaaggacacttgcccaagtgtgtccctaaggtgagcgctttagcatcaagaattattcaactgaaaggagttggccggacccagtggctcacgcctgtaaatctcagcactttgggaggccaaggtgggtggatcacgaggtcaggagttcgagaccagcctggccaacatgacaaaaccccgtccctactaaaaatacaaaaattagccaggcgtggtggtgcgcacctggaatccgagcgacttgggaggctgagacaggagaatcacttgaacctgggaggtggaggttgcagtgagctgagattgcgtcactgcactccagcctgggcgacagagtgagactctgtctcaaaaaaaaaaaaaaagagttttcttctaaatagcttgctgagtttctctattttctttgtacactgaattctaaactctcagttgggagattctgccaatgaaacactctttgcagtctcctacctctgctacctgggcttgcttgatgctgggtgatgaaccacccaggtacctacacaacaccctggttgtcagcagtggcagtggaaaggagagtttgaatttggaatgtagacattttgtaaacaggttcagagaagtaactgcccaccgtcctccccactgtggtgtgcaaagctaaagagctgactcatgtgatcgtgggggttggcaagtccaaaatcggcatggctggagattccagcaggagttgatgttgcagcctggagtccagaggcagtcttaaggccttcaactgattggatgaggcccacccacatgaatggagggtaatctgcttttctcagagtctactgactttaagtgttaatatcatctagtaaataccttcacaacaacatctagactagtatttgacaaaacaactggacaccgtagcctagccaagttgacacataaaattcatcacctcaagaatcagcactaggtttaacatgaaaacaacttgtatttagtgcaatttatcaagtgcatattgagactggctgaggttcttcctggaacttacttctctctctcactttctccctctcttttttttttttttttttgtgagtcttgctctgttgtccaggttggagtgcagtggcatgacctcagctcactgcaacctccacctcctgggttcaagtgattctcctgcctcaacctcccaagtagctgggattacaggcacgtgccaccatgcctggctaatttttgtaattttagtagagatgggattccgccatgttgcccaggctggtctcaaactgatggcctcaagtgatctgccagccttggcctcccaaagtgctgggattacaggcatgagccaccgcacctggcccctggaacttatttgttagtattcaggctactgaggtgttgcacctgcagactctcaggtggcactcacccattctctctctctgccgagctcccgtgttccatcctttgttcctcagtgtccccacctgttaacgtgttgaatgtaatccccgtgtcttttggataaatcagagaatcccatatcatttgttacttaggatcctgagcattcagttttagctttcacactaaagatagagaaaataaaaatagataccattaatctttacacttctcctgtggtcctgattgccaaccatagtctgaaagatctgcagtggatttattactttgcatgttctttatttcctttaaacccgggcgtgtgaggaacgttgatttatggagcctagatcatgcttggctggggaatgggaggagggaagcaaagtgttgttcaagctgcagtaaatttaaacatcactagtatttctttacacatgcaagggggaaaagtcctaacttaagtccattgctacaggagctcataaattaaaaataacaagactatttcctatacacctggagcttcaaaattacatgccgttaattctttgattgcccccttcacaaaagagccattgagggtgacaactcaaacaagatctccaccacagccgtgaaatccaatcagtgattcaccttgtgtctttgaccttgttcaagataaggaagtgacttgtctgaaacatagactctaagaatttagtcccattatttttttcctcaaacttttccctctcattactctcttctctctctctcctctctcgttttattttttctaattttacataaattttaaaacaaatctaacagcatcagaagaccaaaacacaggaaagtcttcttgactttccactatgttctgagccataaatcctttcgtgtgctcaaataatacaccccagctggtctgttggatgaatttggttagcctcttaaatgttttagcacctgtacaccacagagctcccaaaagcgaggaaattatgtttcctcctgtccccaacggattgcttttcacctgggccatatagctgctgtgtgccactttacagaggttaagactgagcagtcctggaggacacagaaagctctaaagaagtacagacacaacttcaagtcctcatatattttacttcttcatcttgttctttgagaactacgtttactttctttgagaaaatgcataaaggagaaagagaggatatactttattttgatttttagagaaccttgaaagtgtcatgccagaagcggtggaattgagttttcactcttataccacccagacctttcactctaggtatataccaaagaaaaatgaaacgaaggcgtttgttcacgtcgagacttgcccgtgaatgttcatggcagtgttattcatcaaagcccccaaaatgtaaactacccaaatatccaccaactgataaatgaatagacaaaaaaaacatggatgtccattcagtgagatactcttcagaatcctcaaacgattgctacacgcaacatgactgaatctcaaataatgatggtaagcgacggaaaccagatcccacctctacagatggaaggctacatatgctgtgatttccttcagtgcaggatagacaatagaaactaatagagtgacaggaagcatatcagtggttgatgggaagtgagggtgggagggaggaaccgattacaaagggctgtgaggaaatgtttgggggtaatggatttgcttatgatcttgactgtgatgatttcacaggtggatacatatgacaaaactcatcaaagtgtgcagtttattatatatcagttacatttcactaaagccaataaatgatggccaggcatggtggctcacacctgtaatcccagaactttggcaggccgaggtgggaggatcacttgggtccaggagtttgagaccagcctgggtgacatggcaagaccctgtctctacaaaaaataaaaaattagccagacttagtggcatgtgcctgtagtcctagctgctctggaggctgaggtgggaggattgattgagcccaggaggttaaggctacagtgagccatgattgtaccactgtactcgagcctgggcaaaggaacaagaccctgtctcaaaaaaaaaaaaaaaaagaaaaaagaaaggtaataaatgaattttgttgggattagagaaaatgttttgagatggggcgagaattgtcttaaaaagtaaatagagttgcaataagtggtcgttttcctctggaaggaaaagtgttaataataggaacccctatgaaatgtattggattggcctcattaactattttttcccccaagggctcaagataagaaagtaccacgggaaatctccaaattggtacacaaatctaaattattttaggtaataaaaaatcatcaaagtagaataaacgggaagaaatgagcagaggagctttaatgagagcaaggagaaacattttgggtaaaataattcaaattattcttatgagatgatagacttggagaaactgtttataattgaggaaggggatgtaaggactttgttgccagaagattcagcctaagatcaccaggagtaactaaatgtgttggacatcatcggaaagaatattgaaaatattgaaacaaagtgaaaggtaccaccttacccttgggcaaagtgaacacttctttcaacctagaagttcctataaagttctgacaggccaggtgcggtggctcacgcctgtaatcccagcacttggggaggccgaggcgggcagatcacgaggtgaggagatcgagaccatcctggctaacacggtgaaaccccgtctctactaaaaatacaaaaaattagccgggcgtggtggcgggagcctgtagtcccagctactcgggaggctgaggcaggagaatggcgtgaacctgggaggcggagctcgcagtgagccgagatcgtgccactgcacaccagcctgggcgacagagccagactctgcctaaaaaaaaaaaaaaactaaaaggttctcacaagttcaacttataaaagggaagcaaagcctggtgagcgggtagagactcccatttgagaacgggcatttggaagaactccctagtccggatgacaagagctagggtgcaatctgagtagctcatttggcacgtggatagattattcattaagttttggaactatctcttaagacggggaagaagcagccttagggaacaacaaaacaagctgtattccacatcctaagacacagtaccgactgagaatataaatctgcaggtccagattaatccacagatggcaggctgcttgcaagctattagacaaagccaggggtgttcgggagcagatccccaacttctgactccatagagggtcacagcctgcctctcttgcacagaaagagatggaattctcagctaagtgccacaggacttctgtccaatacactagcccttctagtctgtttctgaaatagtcttttctacatcattttttaaagcggtccgttattccgagcacttttatcatgtaacacatcagctgccataaaagcttgaaggtggctgaaagtgggcgaggatctagaagccccttgggcaagtccagattggaaacacgtcatgggacctccttttagggacagtctcacaggcaggctgccgtaggatgacctcaggtgtcccatgttttgggtgggaatgtcaacagagcagatgcgagaggcatttcacccaagcacctggattgtttcatgcctgaaaggaggcaagacaggaaggtataaaatccagatcggtgcagttgctcagaaaagggacaggtgacggcctggcgttctctccttggcttcctgtggaatttcaaagttactgctttgggattgtgaactccagccatctgcgtgcttggaacctggagagcaatccagctggtgtctaccaccgtaattaagaggggtgtggagcatgtaggtgttatacacccctgccaatcaccaggaaggagctgagtgtggaattcacatttgaaagtgaagatgcaggaagcctgatagctcccaaaagaaacggccaccagattttgtttaaaacaaacaaacaacaacaacaaaacacacaaaaacaacggaagggtacactttagaaaaactattgactttttcccaagatatctgtacctcagccacaactacaaaaaagagtctcttcctctgttgctggcatctagtctgctgtaattgtagaattttctgatgctccatggccatcgttgcttctttgtcctccccactatttcatccgccggctcctgggaggggagggttccagttcactcggctaacgtgtgtgagtccgacagtaacgagcaacgcagaccccgggaagaggaacaagaataggacattcctatatttttatgtggagattgataatcaaggctaacaatcctggcagaaggtgaacaacacattaaacagaggggaaaagataataaaatatctcctgatgcttaacaatcgttgggtggaaacattccctggaattatacagctgttgcatttgatggctcataaagcctcagtaaagtccgtcaagggccttttttcttggcgagggaccattcttctcatgcggttatgatagcatctgcttcctgtccctggaagtgcacagaatccacagacactggcagacggaagcaggggaggagccctactgcagaggcatctggccctttgatggcttttgggtaacttctgatctacagggcatcgtatcaaaatgcagactgagatttagtgggtagccagtgagcacttgctaggtgccaggcactggcttagggtatttcattaatcctgacaactatgaggtcagtattaccatttttaaaacaatactatggaaaacagagccctagactccttaagaaacatacccagggcatgcggctgacaagtggcaggctgaagtccccacgcctggtagccttttttctgttactgcaaagatggaggaagaggcgagagttgcttcctgtccgtgctctgggtacgtgtgaaatcttgtgcatcttcttataccgggtgttcaggcacatgtgtgttgagaagggatgctgttttccagaagactcaaaaacaatgatgggggtcctaggtgacttactgttttaggtcggggtccccagaagcagatcttgatgaagtgaggatttctctgcaagtgatttattaagaatgtggtcctcagggaaactgggaagggagtaaaggaggcaggaaagggaaagagacaagccaaagatgagtcctttctcaggcaaaatccggtggacagcggcttttagcttcagcctgaccatactggggaactctgggggtttgtcctgatgggaagcagcagaggtgagcggtcatctccctcactgttcaccctgcagtcatctccctcactgttcacctagagctgtcatctccctcactgttcacctagagctgtcatctccctcactgttcacctacagcggtcatctccctcactgttcacctacagcggtcatctccctcactgttcacctacagcggtcatctccctcactgttcacctacagcggtcatctccctcactgttcacctacagcggtcatctccctcactgttcacctagagcggtcatctccctcactgttcacctagagcggtcatctccctcactgttcacctagagcggtcatctccctcactgttcacctagagcggtcatctccctcactgttcacctagagcggtcatctccctcactgttcacctagagtggtcatctccctcactgttcacctagagcggtcatctccctcactgttcacttagaggagaggtcatctccctcactgttcacctagagctgtcatctccctcactgttcacttagaggagaggtcatctccctcactgttcacctagagctgtcatctccctcactgttcacctacagcggtcatctccctcactgttcacttagaggagaggtcatctccctcactgttcaccctgcggtcatctccctcactgttcacctaaagcggtcatctccctcactgttcacctagagctgtcatctccctcactgttcaccctgcggtcatctctctcactgttcacctagaggagaggtcatctccctcactgttcaccctgcggtcatctccctcactgttcacctagagcggtcatctccctcactgttcatctagaggagaggtcatctccctcactgttcatcctgcggtcatctccctcactgttcacctagagtggtcatctccctcactgttcaccctgcggtcatctccctcaccgttcacctagagcggtcatctccctcactgttcacctagagcggtcatctctctcactgttcacctagaggagaggtcatctccctcactgttcaccctgcggtcatctccctcactgttcacctagagcggtcatctccctcactgttcatctagaggagaggtcatctccctcactgttcaccctgcggtcatctccctcactgttcaccctgcggtcatctccctcactgttcaccctgcggtcatctccctcactgttcaccctgcggtcatctccctcactgttcaccctgcggtcatctccctcactgttcaccctgcggtcatctccctcactgttcacctagagcggtcatctccctcactgttcacctagagcggtcatctccctcactgttcacctagagcggtcatctccctcactgttcatctagaggagaggtcatctccctcactgttcaccctgcggtcatctccctcactgttcaccctgcggtcatctccctcactgttcacctagagcggtcatctcccttactgttcacctagagcggtcatctccctcactgttcacctagagtggtcatctccctcactgttcacctagaggagaggtcatctccctcactgttcacctaggatggttgccgtggggaggaggcgggtggtgaatcccaggccttttcagcggccctccaggcctgcaggttcaagcaggctccagtggcctgagggcaggcctttgagaaagaggctgactgttagaagcagaagcccttgaaggagcacacagaaggggtctgggctaagcagcagcgtggcgacctacacccgcccctcctccgtaccttgcaggaggcagcgggtgctgaggaaatgggaaaagagccgcaagattaaccagatacccgtggtattttcaagcaacaccatctgctgtatttccacagaaagggtgttgattttcctgaattctagaggtggtgttttcatcactgagttcagatgcctttgattgatgagccaccttcaaaccaagtcagcatgaaacagaagcttgggttagttcacgttgtttgatataataggacaaggcagactaacgtctcttgagaatgaagggaagtttttcctacataaacttccacattctctcacaaggtgggaaaataaaaagggaaaatgacgtgaggggttgcccaagacagggatccttcccatctgaaaccatgctgtgacatgaagtgccacagattccaaaatccacgtgtgtctttcttcgaaaccaatagccacgtgtaaaaaaaattatatagcgtataaacccatagcagcaacattttaagtggaaacagatttcttccattttaaagaaatgtcaactgtgttagggagtctggggatccctcgcatacatcccagctgaacatgaaccccaaattcctgtgtaatgtatcgcagaatctgtcctttgctcacttcgtatctgtcatcaatcaacactgcagactctggaagcaagcatgttatggttttactcttgtgactaagcggagacaagaaggcatttttctcctccttgggctgtttggaaagcatagaatgaaatccagggcatggtcatcatgaattatagcgcagccaggctggtctagaatctctcatcttccaggcaaccccagccttggcagcaccatcaaagggtcatggataacaattttaaaatgcagtgaatgaaagtgttcatatgatgctaatggaatcataatttttaaagtgtcctcatcctttagagatatagactaaaatactggcagatgaaatgctatgattatgggacttttgtcacagtaatactacagagagaagtgcgtgcgtgcgcgtgtgtatgtgtgtgtatgcatgcatgtgcgcacgtgggggggatacacatggaataagattggttatggattggcaattgttgaagctgagtgacagacacataggctattctatttttgtatatgtttaaatttttccataataataggtcaaatagatcataagcatagtgtatactcacagatccctccagaagaatctaaatgcccagctacgctggtcaccgagtatccgccttgctctcccaggtgtccataagcccctgccacagggctggtgaggaagcctggctcccagcttgtggctacctttacacccatcactctgctctcctcccagaactccattcctccagtcacagggcccccagcataacaattccattagcatccttccctcccttatttcttgcaaaattactcttatcatgaattccagggactgtgttcatttgagtggcatcatctattactatttcatttaccccatcacatttctttttctcacataaagatacagtcatttgtcacttaataacatacacgttctgagagaggcattgttaggtgattctgtcattgtgcgaacatcatagagtgcacttaacataagcctaaatggtgtagcctactgcacacctcagctatatgatgtagcgtattcattctaggctataaacagtatagcatgttactgtactgagcgctttaggcagttgtaagacagtgctaagtatttgcatatctgaacatatatgaacataaagaaggtatagcaaagatacagtgttatcatcttggggactacagttgtgcatgtggtctgtcattgaccaaaacgttgttctgtgacgcatggccatattaaggtatacactgggtttggctgcttctatacaaggagtttggataaatttcatatagtgtcagtcaaaaaagtataagaaaattaagccaagtataagaagctgtgatttgtcccagacatcatgacctcagaaacagagtgtctgtgtaggtgactgctctacaataggctcaggaaggcatcgtgtctgagggcccaggctacagactcctaagtgtgtttttagcccccaaggccatctccttttggtcattatggaaattctggagcttaattaaaaggaacctagagtgcaacctttagatttaagagtaatagaaagaataactccaaaacctgtttattgtagggcagttaactcttatgtgagctcttcatctcatgatagaaaagggtccctggtggaggggtctgatacaattataattctgctctcccccaatccccaaagcatcaaaatagaactctggcccctctcattatatagagaagcaaatcgttactgtgatcactagggagttcccaccagcattgctgtgggtcctgaaagagaaaaggaggttccatgatttgggaagtaagtttcattttctttcatatttggagagatagtttctgattacagccagtggtctcttctgtaaatataggtgggccatggactctagagactctcaggatataatctgaaggattgattgcatatgaacctgcctacagatgcagctcttggttctgttttggctttgcctcctcccctcactgtgtggtgggtggagctggctcctctcaagctggtgccttcctggtgtgcttgctgctgctgtggtgcccgtggcccatctgaattaacatcttctgcggtgctttagggtgctttgcacaaagtcacttgagactgatggtgctaaggactcatgggtaatggtctagtcttaatgttctaattcaatccaatccaacttttttgttttgcatatctacaaagtgcataggaatatgcttcgtactgggaggagaactcatagtgcttaataaggactgctatggtctgaatgttggtgtgcccctacaattcccatatgggaaacttgatcttcaatgctatagtattaaaagatggagcctttaggaggggatcaggtctcgagggctccatcctcatgaataggattagtgcccttatcaaagaggccagcaggaacttgtccctcccttcgaggtgggaggcggggctggactctggagctgggctcagacaccagaccaaaatgaggactagataaaacagggaaggggcaaaagcagcttttcataagacatgcccaccagtgtgccatgtccgtttactattgtcccaacaacactcaggagttaccgcccctttccgtggcagtgaccccacgacccagaagttcctacccttgtcctagaaatttctgcataaactaccccttaatctacatgtaattaaaagtaaatataaatatgactgcaaaactgccttgagctgccactctcagcacactgcctatggggtagccctgctctgcaggaccagttatggacctgtaacactactggagctgtgacaccgcctctttaataaagctgttttctgctaccctaccaccagctcgcccttgaagttttactgggtgaagccaagaactcttgtgggctacgccccactttggggctcacatgccctgcatcaccttttgccataggaagacacgttgaaagcactatccattagtaatggcccttgccagacaccaaatctgctggcactttgatcttagacttcccagcctccagctgtgaccaataaattccattttatttgtatgttttttttgttgttgttttttcttgagacagggtctcactctgttgcccaggctggagtgcagtggcatgatcttggctcactgcaacctccgccactcaggtgcaagcgattctcctgcctcagcctcccaagtagctgggactacaggtgcacaccaccacacctggctgatttttttatttttttggtagagatggggtttcatcatgttggccaggctggtctcaaactcctgacctcaggtgatctgcccacctgggcctcccaaagtgctgggattacaggcatgagcgaccatgcccggcttgaattctgttgtttttaacttacccagtccaaggtattttgttatagcagcaggactggactaagataaggactaatcttagtaggaaggaattaacatggaccttgtgagttatggctgatgctcaaaagcctggaggacgccttgcagctctttccacatggtgtgttctggaaacactgtcttaactcctctcagtttggtctggagtttgatagtcatgtagatttgggattggcatcacaacctatagtcaaagtgatgaatcctcttgcataacacaactactttgcattttaataattttaataactttgataactaaacatttactcaaaaatgtatttcttgaacatctatggagtccagatattggggtctactaggctttggctgtccttgtgatttttaaaaccagaagcacccagaaactattaaatccttaaagcaatacaaaatattcacagccatagcatgctcagtagagaacctctaatgcctgaaacaaggagactgtttactttagcacgtcagtacttgaggatttattctgtgttgcggcttctggcctgcgagttcagaataacatgatgtggatttggaaccaaaatgaacacagcaacagacagtctatcacgataatgggaaggagctggagtctgcagctgccatcggcatcaaagatctagcttttattgagctctctatatcccgacagatccttgtcgtatggaagtgatttgcgtaggctgagaacagtggggtgaaaagaaccagggcatttctaaaaaccagtgagagcaatttacaagcctgagccaagaaacaagctggacacaccacaaaggaaatgcattttcccagtaactttttttttttggaggaggctttagagggctggcctgtgaattgcatttgtttatgaattgtctagtaatcacttgcattgtcgctggatcaggaggggctgtattttcttcccacacctgatttccatgattcagtgcacctcaagagctccatttgtgtcaccttctctgtggctgacgtgtgcgtttccactttgtactgttaatcagttaagtgaatatgagctgggaagtgtgttcaccaaacacctggctagcccgaagctctttacatttgacaaaacgggagacagaaattagaatggcttttctattttagtctagattatggaattctgtaatcaagattactttaaaaccatcatttgaatgaggaggtaaaatagccttgatacttcactgctggagaggaacaatagacaaactcaaaagacaaaaacatgaattttaaatgacagtttgtcccaaggacatcgtcatactgtgtgctttttacagtctgcttgttatcttatgcaattattgccaatgtgttttgctaatggattcattgcaagtggacttaccctacgtggaatgaggaatgtccatatgtggtagatgtgttatttattgatgaggagaggaaagtggatcaatgtggtctttagatgtgcgtgctttgccttgggaagcaccagcattgtcgtctgaactacaattggtgtgtatctgggtggaatgtggtacccgtggtgagtttgcttgttctctttccgttggcccacttgcagcaaccaactgttgcctggactcggtattttgggggccattttctcttacttttatctgttggccttgtggttccatctgtaggttgctctctccgtctagcttggaaacaacataatgattccttccgaatcactggattcacagggttgagggacttgcctgccactgacattcgttgactgggattagaatttgaaaagattttcgctgttgcctcaggtgttctgaaaggtggaatgaatcatttccactcagttttaatgctagagggagaaaggagtcatgttaattagatgggaaagatgatctaatcctttctcaaagagcctttctataaggtttagggtactgtccagccagcctgcggctgcgtgagactaatgatgggtactgggctgttgttccatttctgctaccattcattgttggtgcctttggtaaataattccatttcattgtgacttcatcttctcattgggaaaatgagactggtgatgttgcgcctcttgggttaggcgtattctgtggtaggatttagagtcaaaagtgttttttatactaaaagacactatggcacatcttcgtaggacattagcttttctttgaagatctggtggtggggggaaggggaaccattttttgaacagtaaaaaataaagagatatagtatggaaaacaatgtgaaatgtgaatgaatttttaagatagatattttaagatgaatttttaagatattttaagatgaattttaagatgaatttttaagatagatatgctgctaagtaatttcttgctagatttcaactgctttggggtgtgtcttcctatggaaatgaattcctcgtgcccacggccattacatttcctacaacggaaactttgacttttgtttttttttgaagagacattttgacttattttttattctaccgtttttctatttgctacctcatttatttctacttctagtttgttattttcttccttctgctttatgttattcttttttgtaacttttagaatttggaatttaatgctttttaaaatttttatcaatataagtatttaggccataaatgtcccactgttcagtactttaattgtattttatgtattcagatagatagtgtttttattaacatttcgttttagaaattctgcaatttgggtttgtagttctccctttacccaataattacttaatatcaaatttttaaatttctgagggtaacagcctctttgttttattacatttatttatttctggttgtcttctattatgatcagataatattgtttttattttttaatttatgaatttattgagatttgctctgagttagttaatgtatagccaatttttatgaatttcacttgagaaggtgtattctcctttgggtacaaagtataatatgtatccagaagatctatcttttttttttttttttttttttttttttggtttttgagatggagtcttgctctctcacccaggcaagtgcagtggcacaatctcagcttactgcaacctctgcctcctgggttcaaaaattctcctgcctcagcctcccgagtagctgggattacaggcacccgccatcatgaccagctaatttttgtattttttgtagagatggggtttcaccatgttggccagcctggtcttgaactcctgacctcaggtgatccacccacctcggcctcccaaagtgctgggattacaggtatgagccaccatgcctggctaagatctatctttttaaaaaaattatttactgtggcaaaatacatttaacctaagatatgcgattctaagcatttttagttgtacaattcagtggcattaattacattcacattgttgtagaactatcaccattacctgttttcaaaactttttcatccctccaaacaatctctgtaaccattaagtaataactccccactctcctcccctcaacccctggtggcctccaatccactttttgtttctgtggatttgcctactcataaaagtggaatcatacaatatttaaccttttgtgtctgatttatttcacttagcataatattttcaaggtttatccatgttgtagtgtgcatcggaattttattcctttgtatggctgaataacagcatatcattgtatgtattatatataccatacttttttatttatttatctgttcatagacacttggactgtttccatctttggctattatgtaagtaatgctgctatgaacgatggtgttcaaatatctctttgagtctctgtgttcagttcttttgggtttataactatgagtggaattgccgagtcatacaacacttgtatgtttagctttttgaggaaccgtccaactgttttccacagcggctgcccattttacccatcagcaatataccagggttccagtttcttcacattctcgacagtatttattttccttttttttaaaaaaagaaaaagttatggccattctattagatatgaggtggtatgtcatgattttgatttgcatttccctagtgactaagagatgatgttgatcatctcttcatgtgtttactggtcatttgaatatcttctttggaaaaaaaagtctattcaaatccttcgtccattatctttatattgttgagttttaggagttctttatatattctggatacaaacatttatcatatatatgatttgtaaatattttcttccattctatagtttgtctttacacttttttgataatgtcctttggtgcacaaaagcttttaattttagtgaagtccagtttatcttttcttctgttgcttgtgcttttagtgtcatatttaataatctgttgtcaaatcctaagttgcaaagatttacctgtatgttttctcctaagggttttatagttatagctctcatatttgggttctttacctattttgagttaattttttgtgtatggtgtgaggtaggggcccaacttcattcctttgcatgtagaaatctggttgtcccagaacactagatctgttttattgatcatgttatttagatcttctatagctttatttttttaaaaaatctccctgaattaccttggactaagagtggcaatttcaagcagcattattaagagccatacagaagcctgaggcaaaaggaaaaatcagtaatactgcatcctgtctttatataaaatataaaattttcacattttattcatcacaattttttgcatttatttttattttttaaagtattgcattaaaagattattgattttggttcctgagtttttgccatcaccttgaattatgtgaccaagaagagtgccttttcaccttactatagtcccagccctggggtaaaggctcctaatttgagtgtgtttctgtctatgtcttcttgcagctcatgtggttttgcatttttgaaagcggttgccatgtatctggtataaaaatattcacaagtgttttacttctgctgtaaattgtgactttttctattacagtgttatttgtcgtaatactttttggcatggattctgccttgtctgttatcaggattacaaacgataggggaaaagataagacactaacaagtcttcagtttaccaatgatgaaatcagggcccaaggactctggcaacagttgaaagaattatgatcattaagttaaaaatgtttattacttctaaatcctgatattaaagtaacagcccagcgtacttccatgtagaaatgatgtcattctgaaatggtataaataaaaattatagtcaatattctcatcatgttcaagcagggcatgggccacaaacccacctaaggacctgggaagggcgggtttcaataaccttcaggctgaatgccactcatacaaataagaagcgtggaagctgagggaaggccaatcagttgaagtagggtgattcagcccactcaatatttgaaatattggttttaatgagatcctagggctccattttagagctactagaagttttatgagtgaagaagggagctgttttactgcactatacagagtctccttatctttcccttttgtcattcttgccataaccttatagcctctaacttaatcagcctggcttccttcacgtaatacagcagcacttaacattgccttcttacttttcttctaagtagttctagtttctatgtctgagcatccagggaggtaaatgcaaagaaggatggaaataaaatatggctcagctgtggcctgagcagccccttccaaatgcactcacggcttctctgcacatcttgatatgtgaatgggaaagaaaaaaaagcacattttggtccagcaggttttcttccctttgtctccctctgaggtgctcagaggcatcagtaacagagcaggaaggccctggccaacaaaccttagccttttcctttgataccttccattgggagccttcatacaatgcatttgaaagcactttgtcagcagactcctgcttcaggcaaacattgagaaaactattgaggaggcctcaatggaaaggatctgatctgccccagaaactgccctagttctctggcaggagagccaccagcaggagaagagaagtcctctctcctaccccattttttttctttctcctttttcctctcctttctattgtaagaattgtgggaactctctttaaatgaaaataactctcaggctgagctttgtctcccaatgtggataaatgcccagatatctcatatcccctctgtaaagctggagtctcagttttggatgatcacaaactatttgggacaaatgtttgagctcaaggagaaacacatggtaggtggtgtgtgcatagctttttctaaagcacctaaaaattgaatacttgttcatcagcctactgcttgcaagccctttgctaccacttgctggtctgttgtttgcgcctctgcaggctggctctgtgtcatgtttgcattggtatccgatctctccctgcaccaccccttgctcgattttaattgaatttaatgatttctgaacccctaagcgtctatcactttttaaaatccatactacaggccgggcatggtggctcacgcccgtaatccgagcactttgggaggctgaggcgggcagatcacgaggtcaagagatcgagaccatcctggccaacatggtgaaaccccatctctactaaaaatacaaaaattagctggggatggttacacgtgcctatagtcccagctactcgggaggctgaggcaggagagtcgcttgaacccgggaggcggaggttgcagtgagtcgagatcacaccactgctctccagcctggtgacagagtgagatctgtctgaaaaaaacaaaacaaacaaacaaaaaacaacacacaaaaaaacatactgcattagtttctacctacagtttcagtataagcaaatgcttaaggtgacgatgccaagagaaataaaagctctctttagctgccttcttctcccgtcattgagaagagccttattagatacagatggatgaatattcaagaagccagagagtgtgaagaagtgagagaggctgacccttgccctgagcaatgctagactcttggttgggaagttctgttctgccagcacccctgaggccagagaggccttgctggtcttctctgcgtctccctcaggacatggctgcccagtggaggacattcagccactcagcactgggtatgatcttcccttaacctattcccgtctatcaaaatgaagagccacttctagatctaaatttctgtaattatctgataatttatgttttattctaattacaaatctggcccattaaaaaaaattgagactgtatcagggtataaagaaaaaagacacccatgattccaggagtcagggataaccattagtggctttttagtgtgttaccttctcatcttttttcatacatctgtagttattttgcagaattagattcctgtgtgtatgcaacattttcttcactaaccttatctcttgaacatttacctgtgtcatttagtataaactgaaaaataaatatccgtgaagactctagatcattacattatgtggattatattttatttaatgaataccttatcgttgtatatttaagtgttttgctgtgataaatgatgctgccatgaatatgtttgcacacaaatctttgtacacatctgcgtttatttccttagtatataattctagcagtcaaggtgttttgatatttttaaggcacttaatacacaatgccaaattctacaccagcactatatgaatgcccagtttctggaacccactccaatactgaatgcgatctttgcgtatttgatagtttaaaattatacctcactttaaaagttgtttccttttcttgctcatttggttgaatgttttcatgtgtctatcagccatttaaattatcctgctaaatttttttctgtggcttttagtcttccttccattaggatatttgggtttttcttagtgatttttaagaactctaggattctattattttaaaatataaattgagttaccaaaatagtttaaattttaacaaaactgctgtagctggcctccttttataaggtaaccttgttattgtttgccagctgttgtgcctggcacagagctatgcatacccaaggggctacataaatgctttttcattttttatttttatttttatttatttgtttacttatttattgagacagaatctccctctgttgcccagtctggagtgcagtggcatgatcttggctcactgcaacctttgtctcctgggttcaagcgattctcctgcctcagcctcctgtgtagctgggaccacagctgcatgctaccatgcccagctaatttttgtatttttagtagagatggggtttcaccacgttggccaggctgggctcgaactcctgacgtcaggtgatctgcccgcctcggcctcccaaagtgctgggattacaggcatgagccactgcacccagcccataaatgcttttttaatgagagaatgacctattatctaaacataattgatgtacagtgttggttagcagagctagtaggagaatttttagtccattaggagttataagaaaagcttttagaatgaattgtcccagaaaggagagctggaagaaaaaaacccaaaacaatattccacatccacatatatgacctaatgttagcggaacatcacagaggacaaatatcgcaaatcagaacaaaaggacagctcagaggtatttttcaaattgaacaaaattgtatgcatgcaaaatataaatagaatgatattagaaagattttatcaaatcttaatgtttcggcacttttttcctgctgtttttaaagaaataaaacatgacagaacagttgacacctctgcatttctccttttatctcatccccctttcatctataacacaggtggctttgattttgaatatggtgcttatcatctgagtgtgtgctttcatgctttgatgacataagtgtacaaatggtatcatactttgtttcctattgcaacatttcttttctcattcaatattatatatttgagattgatccattttaatagtattacatcataggagatttcacaacttatttattcactctctcatgtatggtcattccagtattttgctcttgcaaatgttgctacaacgagcattgttgatcatgctcccttttgcacacagataagtttctctagggtggaaatggaattgattgctaagtcataggtatggatctccttcttttctagaaagagccaaatcatttttcaagtttttaaggtattatataaatacctgcatttcccccaaggacattttacgtaaatgatgccagttaatatttgtgagtgcttcctatgggccaggaactgtcctaagggttttatatgattccacacatttgatcctcaactattcatttgacaagtgaggaaactgagattcagagaacttgaggatcttggccaaggtcttatagcaagtgccggagcccactcaaacccctcggcagtgtcgttctcaagccctctctcttaaccccaggctgtgctctaggtgctagaaagacactacccatgccagtttatagggatataaaggcagcggctatttaggctgtaagaaaactccaacaaaccgaagcagccttcctagagcattgctgttgtacagataggaagaagaaccagatggttgctcaatgtgtccaaggtccgcccgtcagtgactgatccaagactaaattccaggctctagacgcacatggcagccaggttctttgctccctggctctcgctgtctcactctcccttgctccctccttccctgtgtattcctgaaggcatatagctacatcttcatgtgcttttaatttcttttagcctagagtagacgctcataatagaaaggtcaaataaaattttttaggagtagtaatggatgtaatcttgtacatgtacatgttaattgcagcactttaatccccattctaagtaccaaactttccggattaatttcctgcatctgttggtaacacgggactcagtcttctgaccagattctttgcccaagggccctcatttactaatgagtaatcactgcaatttcagagaaaatgctactggtacactcatgtttgaacattcatcaaatatgacgtgagcccagttaggagagatgttagcgtccttagcctacaaataagggcatagaattaaatctccccacgctataattttgttggggttattacttgcatcaatgtttggaacagttggtgataaaacgtttcatggtcttacagctcagtagataggagcatgtcatgagtcaggcttaccaaaggacttactgcagacttacttccccttgcctcctgtgattcaagccaattttgcaaagagaagacagaggtggaagaggaagtcccttcagcaggaatgcatttctctttgtgcacatatcacagacacacagcactgacacactaattatagctttaggttgagcatttccagtttctgcattttgtttgcaaacagcccattatttctatcctgtgtgctggaaaaacacaaaatgaagcagtctaatcactactgtttctggtaggtccagctgtctacctgtctcccctcttttggttttatttttttcagggtgggcctgtaactcctcttctatccccacccgattttgttttttggaatctttctaacctgcctgcagaccaggggttgcagttccagctttccatgatcttacctgtgttcagccttatctattttgtattgaaagaaacagtcaacacagtcaaatcctttataccttccttaagactgcactggtgtggcctacatagccacctgtgtgccagctgctgtttgtcactaggaagacagggtgggatgtgcgggtggtatgaccgaggtgtgaagaatctcagggttggctgtgtcagtgaaggagtgaacgggcactttggggtcacctgaactgggagaactaagttctcaagcagcaaaaacagaggcacaaaagtggataaaaacccaatagtgcagacctggagctaggcttcttctctcagtggtggcacagaaaaggatgaaagtctctgaaatgtgcacctgtgattcaggttgccacccactgaaaaatcatgattcaagatctctcctcctcataaaccttttttttttttccctgcctgcagcctaagatagaattaggaagtcaagaaaggctctagatgactttcagagtgttttttgtttgtttgttttttctttttgagacagtctcgctctatcatctaggctggagtgcagtggcatggtatcgtctcactacaacctctgtctcccaggttcaagtgattctcctgcctcagcctcctagcagctgagattacaagtgcctggctaatttttgtatttttaatagagacagggtttcaccatgttggtcgggctgtctcaaactcctgacctcaggtgatctgcccacctcggcctcccaaagtgctgggattacaggcgtgagccaccacgcctggcccagaggtttgttttttttgttttgtttttgtttttgtttttccagaattagcacatcttctcttctctgggtcatttttctcttaaatcagagattgcaaaatgtggtccaagggtcaaatccagcctggagtcccctgttttggtaatgtttccttgtaacacagccacccccattttttacaggctgtctgtggctgcttttgtgatacgatgcaggagttgagaagttggacagagaccatatagtttaaaatatttaccaccctagcctttgcagaaagttcgcccaccccttagagtacagaaaaagaaagatttcagagatgtcagtttgggaaggtccttgaaaagtcacttggcaaagaaaagttgtgagaagaaggttgatgttttgtcaaagaaatgcaacgatgacagatgccaacctgccttttcttccagcggcagaggacctcaggccgtggtgtgcatgcccgtgtatcggtgtgggtatgtgcacctgcacacatgtgtgcttacacgcagctcaaaacggtgccaccctgtccagagttattttggccatcatggttcaaatcaacagacttttctggaaagcttctgcacacatgccatgctcagaacaggaggtgcaaagatgggaaaggattctgcctgatatgcaaatagtgaccgaaaacaaatagtaaggagtgaggctgatggagagctaggggaaacaactcactgtccctgggagggctgcagaggacccagcacaggcgttctggggtgtaatcttccttccattctcgtgagagaagctgagtggaaaccaagagcctggcttttcagtgaggacatgaagcctctgatagttgccttccctctggaggtgaagcagtcctggaagaaaacatattcttacctcaaattccaaaacaacatgtggggactctgttgagaagcctgggtgacctagggctgacgtggtagaatccagactgattctgcttctgctttctcttaaagtcagctcagttttcccaatttttatctttttttttttcagggtctctctctgtcaccccagcaagagtgcagggctcactgcagccttgacctcccaggcccaagcaatgcccccacctcagcctcccaggtagctaggattacgattgcaccccaccatggttttcccaatcttataactaattagatccgctcatcacgtgtcctgcaagcatgcagtggcatgtcacagtgcccatctgacagcagggcagggtcgtttgttgagagaaacccactgaggaggaaataaattaatgtccatcctttgctcccatcacctccagctgcaccatccttcaccaggacccatcagagcttccccggggatgctgccctgtggttctcggggaagctgagagctctatgttgcatcttccagggcacctgtggtctccgaagtgttggctgcaagaatggctaagcagcgcactctcttcagacaagaatagtattttaattgccgacagaatgcagatatcgtttccactattgcctctgacacttaattttaggccgggcatggtgactcatgccagtaatcccagcctttagagaggctgagcctggaggactgcctgaggctagaagtttgagaccagccctggcaacatggtgagaccctgtctttaccaaaaaaagaagaaggagaaggagaaattaaaattagccaggcatggtggtgcatgcctgtagtcccaggtactcaggaggctgaggcaggaggccaggagtttgaggttacaagtgagctatgattgtaccactgcactccagccttggcaatggagagagaccctgtctcagaaaaagaaaaaaaattaaaaaatgaaaaaaagaagaagaaatgtaagtttaggcatcttgaaggcaggagattttgactggtaatggtggaaggattttgcaaaactccatgagttgacctcattcctcagaaattccattgagaatggagggtgttatgtgaaaatccgaatcacaggggatggcttcgagacatgtggaaagaatgccgccattacatatgcacgcgtagtgtttgccccagaggaggcttttgaaaagttcatctacaatgtgctaaagtcgagttttgcagtgacttcctagcgcatttagactgggcatagtttacattactgagtatttatcagccagcaaatcaaagccagaaataggttactcctttgtggagcaggagacagtgactgtcctgggaggaagtgactgtcacagcaatggattcctttagtagcatcttcactgtgtattcaccgggtacccaccgtgttagcgatgacagccaccctgtatcaggtactcccaagtgtccgttcccctgttactgagcactttacaggcactcttgttttgtgctcacagtaaccattgagggagatgaggcacagaatatgaagttagttgccaaaagttgccagagctgggatttgggctccaggtggactgactttagaggctgtgccctccatccttgccctgaacaacctcctgtgaagaaatcagtgtgaatgaatgaatgaatgaatgaatgaatgaatgaataagacctgaagaggcaggcaggctctgggagatgcagagacaacttctgcccagtttgtgctcaggttgtggagacaaggcttcctacgagatgcacacacagaaatttggcagaatgggtaagtggatagcacacagtatgaggtgggtccaatgactgctgagattccctctgtcctccacccacactttctcaacggtgtccttctcagaagagaacctgcttcttcgaccggcctggtaggaacagcactcaccacccatttgtgtgccagtacaggtaagtaagagtgctcccggccgcccttcagccgtggtgctcaatctgctgcatgcatcaccttagccaatcctcacgtcaatcccactaggtagggattatcactgcagttatatagacaagggacctgtggctcagggaggttaagctacttgccagatctcatggctaagaagtggcagaaccaggattcatgcaatggtgtggccgtccttcaaatcctgtgaacctcccatgggaacctcccatgacatcttgtgtctcccctggatatacatccgtaccatgacgggttttcttttttcctggtgggaaagggcagctgggggtgagaatgctccagagagtggcagaatggagctatggacatgaaagtatttggatcgttgggaagtgcagaggtcagctccgcacacacttcctgggactttgcagtcaatggttactgaagttacttaatacccacttgtcccacgactggtgagtcccgcctattgcctgctgtcctgtggtgcagctgctgtttgtccatctccagggccaccaaagcccgtctggattgtgattcaaggtgtaagaggacatggaaaaagaactgatttgtgttgtatgagtttagtttaacttgattacaggaaactgttggtgggtgaatgtaggatttcattgcgtataaacatttcagagacaagtccctttcagctactttctacttgggaatacttgtgaggtttttcacctaaggcttccccgtaatgattttgtcctgatgattcattccttaattagtggtattttattgccgctttgccacagagctttcaaaaccatcacctcctcctcctcctctggaaaacgtgcacagactttgcccacatttaatcatgccatccccaccctttctagtctttcttcaaacttctaccagttcctgtgtttctgagaggagcccaagtcaaacactatgagataaacatcaagagcttaaaatgaatgcatgttcaaaaaatatgctggtctctgattccaaacatggctactgctaacccattgaagacccatcaaagacctgactattctgaattgttttaatagcagtgaggggtgagtcgatgtctcaggagaggatggcccagacctaggtaatgtgtgtcccgtcccccgacccagtgagcacgtgtgtgcatctgtgggtgtgtgcgtgtgtgggtgtgtgtaggtgtgtgtgtgtgggtgtgtgcgtatgtgggggtgtgtgtgggtgtgtgcatgtctgggtgtgtgggtgtgtatgtgtgcgtgcgcgtgtgggggtgtgtgcccgtgggtgtgtgtgggcgtgtgcatgtgtggatgtgtggcaccatgtgtgtgggtgtgcgtgggtgtgttcctgtgtgggtgtgtgggtgtgtgtgcacgtgtgtgggtgtgtgctgtgcgtgtgggtgtgtgggtgtgtgcatgtttggcaccgtgtgtgtgggtgtgcgtgtgtgtgtgtgggtgtgtgcatgtgtgagtatgtgcatgtgtgtgcaagcgtctggcacacggtgtttttgactggactgaggttgtggtaccagagtccagaagacagacagttgaagttgtgtcgtggagggacactgacatgaaatctggcaagtcatgtccaaaccaggtcactaatcaattgtgagcagagagcagtgagcagagggcagcagctatgtgcagagccagaggccggggttcgaatgcacaggagccacgtggacactgctgcaggctgcccgggcacccagccgcagattacctgtgttacctcatgcctttttttttttttttgagactgagtctcactctgtcgcccaggctggagtgcaggggcgcgatctcggctcactgcaagctccgcctcccgggttcacgccattctcctgcctcagcctcccgagcagctgggactacaggcgcccgccaccacacccggctaattttttgtatttttagtagagacggggtttccccatgttggccaggatggtctccatctcctgacctcgtgatccgcccgcctcggcctcccaaagtgctgggatcacaggcgtgagccaccgcgcccggacccattgcctcatttcttcctccagccgcctgtgggtggggactgttcccgctgcagtctcctgggtgagagatgagggagctgctggtgagaggcggttgccccatcacctaagctcgtgaccaggggagggggaaaagcatcactgctcaggcaggagcccccatgcctcctgcttggggttcacttaaaggcacggcttagagagattctatcgaccaaaggatggaaagagccacggagaaagtatctttccggtttttgctttcctctgtgttccgtttccttcccatttacacaggtgcctttagcacgtagatattcacagctctctagagtcaccaactcctcgaatatccctggggtcctggcagaaagcggatggcgcgctgcgtctaacggagagtttttggaaaggactgtttacaaaagctgtcgcaggtgcaggcaagccgtggtgcgcagtgctcctgccagccgctggggaggcctgagggcaggaggggaagccacgaccaccaccccgagagggaggacccgggagcatcagctgagaggcatcatgggacaggagccaggaggacaagtgccctgtcctctcccatctccttctgcgctctccaagggctgagcccatcctgaagccagaaggaagcctgtcgaggcagcttgcatccgtctgcctcctggcgcagagcagagtagagagattgaagagtggacctggacgggcaagtgttcatagaaggcgcacagtacgagcatctcatgaaaacagtgggccctgctgctcagaaaaatgcccaaacacaccaaatgtggcatatgttttcaggggatccatataccccttttagccagtctctggaccagactgtagagtaagagtctgatttagatcgatgggaatgtttgtttgtttgtttgtttgtttgtttccctcctgataaaaaatcctggggtttgtgctctcctttaagtctgtaacagctgagtgaacaaatggcctgcacgccggctcccaggtcagatgtccagcaagcagacgcttcttttcttgtttctctgtctcaagggagcaagtaagtccagaagaagaaaggatctggtgaaggaggctgcaacccgaagttattttaagagagtgttgaaaatgagggctatctaaagcagaatgtgtggctgggatttacaaggtaaatcaaagcagctgtaggaaggaaagaaaagattttcaatgacaaacgttttcctttttacttgttcttttgaaagaaaggggaatgtgtgggcagacagttgtgaggatcttgacttaaatacttgactgccttttcacatgcatgctttaaaaactctctggttccggctgggcgtggtggctcacgcctgtaatcccagcactttaggaggccaaagcaggtggatcacttcaggtcaggagttcgagaccagcctggccaacatggtgaaaccctgtctccactaaaaatacaaaaattagcagggcgtggtggtgagtgcctgtaatcccagctacttgggaggctgcggcacgagaattgcttgaacccaggggacagaggttgccgtgagctgagatggcgccaccgcactccagcctgggcaacagactccatctcaaaaagaaagacaaaccaacaaaaagaaaaacacaaaaactttctggtttcttaaatgaatgacactcacttcgagaagaaggcccgtctaacctcagccttatttttgcattcagctagataataaagtcactcaaggtcttgggtccaaccagatgctaaaaatggctgtttttgctcaacactataagattggaagtcagggagctttggactttggacatttggaactgaggattcacctagaacatcaacgtttttgaacattccataataaaataaatcctgttaactcttaggcatttatacccccaatgtggtgggataaaaggatgaggaaaaaagtggcaccaagatgatgcgagctctttattctgtgtttcggtctcatcccattcagatgcttcttcatggaacatttccaggcagtggtgcctgatattcttcatttcttgaaaattctggttttgttgccctgagagtttgagatgaaaatctggttcctggagaaaagggtcttcttctatcagtgaagcccgtcagtgtttggttctggagtgactgcaaacaaaaagagccctccaagtctcagctcttcccctctctgctggtagatggaaatctctggatctgaattcctaatgggccccaccagtctgatattttaattagtctggtttaaacatggttggaggccgggcgcggtggctcatgcctgtaatctcagcactttgggaggctgaggtgggcggatcacttgaggtcaggagtttgagaccagcctggccaacatggtgaaaccccatctctactaaaaatacaaaaattagttggccatggcggtgtgtgcctgtaatcccagctactagggaggctgaggcaggagaatcacttgaacccaggaggtggaggttgcagtgagctgagatcttgccactgcattccagcctgggcaacagagtcataaaaaaaaaaagtgggggttggggggttggcagtggccttcacacacagcagtctctgcctttaataatggtttaaatcatgtgttagatctaggccctttggtgagagccaggttgaacacccctgaagcatttgctctttgatctatggcctcctattcctttgaactttcccagaaagcagggtgggggtggggatggggaacactaacccagaattctttaaatttctttctaatgatttggaatgatcagaaacttttaaaccaacttcatttccaccttccagccatgcttatccatcgtaagactatttttatcttccataagaacccattctccagtgactcttagatggaaaacacaacactacagagttaccataaaccacttttccttaattgctgacatggaaccagacagaggggggtcattggtttggagaaggagagggagggagaatatctacgccctctctgtccccttcccagacacctcattgcctctgaggattctcttcccttcactctcatcacaaaagaggtaattaccttatttcaggcatcctttttatagagcaggcagcagcctgtcacggtagtagcatttcactcttccaagaatggaaccattgcacaatgtcccaggagtcatttgtgatttttatgagaacctgaagaggttaaagaaaagaacagaaaaataagaaagcctttgctgagaagaagggagctgttagccaaaagagggaatttgggctgagaaattattgtctgaaatacttacatcttagagagagagagagagagagagaggtgagggaggggctttgttattgaattgagtgacatttctctttattataaagttataacgtccggcagtagaactgccagtaaaactcgatctggagtgttttctttccccctcgctatgctcttttagcagtttgcatctggactgttaaattaagggttcttgcatgggaaatacttcttattccttcagcaagtgaaactacttgctaaagtaattatttttaaatgcaaatatatatacacacataccttgtgtgtatgtatttttaaatatttacacacaatatatattcatgtatatgtatgtatgttgtatttttgtggttttgtgttttaacatcagctgcggtagaaagagaagggtggctctgctaagagtccctcctcaactggcctctggctgcaacgtaaatgacctcccttgttccctaccagcatggctggagcaaaaacgccagagtctcacgtacaaacattacctggagtcttcctactgcactcctgcactgtggcatccagagaaacagcgtcacttggggagaatgtcatgcactcctgcactgtggcatccagagaaacagcgtcactcaggggagaatgtcaggcagggatgagctgccttgacttgaaatggtcttgcctctcatctcaattaaaatcaagccattaactggctttaatgtagagattttgtggttcagttttcttcagtggtatccattataaaaaaagatgggggttataggtagcagaactgattggcatagttgtcaggcatatagtatgtattattaatatttaatatgtattattaatgttccctacctatagtgagagctatcctggcttaatcagttatccttcactccaggacgaaaccatgctttctgtggttacctgaattccaggtggggctaagcacagctaagagtatctggtagcctcttcaagtggcttttgtatcacccaaaccttttaaaaactgccacacaaactgataaaaacgtatacttctgtctatccttgattgaatgtaattgtcactatttattttaaagaaatggacaacttagagccctattgcaacacatcccaaacccagctcacttaaaccattaatcaaaacatttttcctccctacctgtggtctgtaaggaggatacaatctagtctctgattgcacaattaaacaggtgcagaaagcagtctatggattcatgccaaatgagtggtactggaagggaattctatgggagttcaaagaaaccggaggtcacagtagatcagagttggttggcgggagtctcgggggagaaatggggtttgacgtaggccttgaaagaaccgataggattcagacaaacctgagtaatgggagggtgttccgagccacacacactgattgttcagtttggtttgctcagctagaggacgtgttgggaagatgggtctgattggaggtgacgttgacacccagacttagattctaagggcagggggagttccctgaaggattttaagtgccaggggcctggtagtgctcgtgtgttaggcagaagggaggcgaactaggctgtcacaatcatctagattggagttactgagaatctggatcgggtggacatgaaaagaaagcagtggattcaagttacaaaggaagaattggcaaggggtggcaaaacagtcactgcttggaaaaaccatttttctgaagcataatgccactttgtttttgtttttgtttttgagatggagtctcactctgtcgcccaggctggagtgcagtggtgcgatctcggctcactgcaagctccgcctcccgggttcacgccattctcctgcctcagcctcccgagtagctgggaccacaggcacccgccaccacgcccggctaattttttgtatttttagtagagacagggtttcaccgagttagccaggatggtctccatctcctgaccttgtgatctgcccgcctcggcctcccaaagtgctgggattacaggcgtgagccaccacgcccggccaccactttgacccctgtctttgctctgtgtctcctgaaggacaagaaggccatcgtgctaggcttcggaattccctgcctattcgtgcataatttgaaatcatctctatgtagctttcagatgctcatttccttctggactccctagtacaatttcatcaatttcatattctctctctctctcctctcataggtatatagtatatattttacttgatgactgactcaagaattttcagatgggttctgatcttgtttagctggaagcattttctagagagccaaagccattgttattttggcttctacatttattgtcgtatattcaagcagaacagtgtaaaaatgattaccaaagttgagcctattatttagattttgatagtatgtgtgtgtgtgtgtgtatatatatatatatttgagaaggagttttgccctgtcacctagactggagtacagtggcaccatctcggctcactgcaacctccacctcccaggttcgtgcagttctcctgccttggcctcccgagtagctgggattacaggcatgcaccaccacgcccagctaatttttattgtatttatagtagagacggggtttcatcatgtcggccaggctggtcttgaactcctgacctcaggtgatccacccacctcggcctcccaaagtgctgggattacaggtgtgagctaccacacctggcctgatagttatgtttttaactctagatgactaaaagacacctataaagatatagaagttaagacaaaagtcacaattatgttgacaactgctgttacagtgttttcaatatatttatccaatagaaaagttttattttactgcacaataatatgttctattaaattaataaaaacgtactcatgagtgacttcttgtcatacagatctctatatctcttagagctgtatgtcggcgttttctctctggatatataatatacatattaatcaattcattcattgagcctgtgcttggcatgattccaggtgcttcagtataatagagcaataaagacaagccccctgctctcttagatcttacttttttttttttttgaaatggaattttgctcttgtctcccaggctggagtgcaatggcacgatctcggctcactgcaacctccacctcccgggttcaagtgattctcctgcctcagcctcccgagtagctgagattacaggcgcccgccaccacacccagctagtttttgtatttttagtagagatggggtttcaccatgttggccaggctggtctcaagctcctgacctcagatgatccgcccacctcggcttctcaaagtgctgggattacaggcgtgagccactgcgcccagtcagatcttacattctgatagagggatatagacaataaacaagccagaaaatacctgccagtcaaaaagctgtgatgggaaccagccaggcaaagatctagagggagagcaccaggcctgtctccacttatgtgagacgtacagaaacacacagcgccttgcccgtgggaggttctcaccacgtatttattgaggaataaatgagtgaatggatgtattcattggcctgcttgtaaaaccttcaccagtggactcttggcttttagaactttattacaggttgagtaatatctgaaatatcccttattcagaacacttgaaaccagaggtgtcttggattttgaattttggggggtttggaaatatttctactgtacttatatttatcaagtgagcaccctaaaatgaaaatctgaagtcctgaatgctgcagtgagcattctctttgagcatcatgctggtgcttaaaaagttttggattctggagcattttgggttagggatcttcaaccggtatgctaacaatagtgatcttatgtagtattttccctccaaagagatttgagagagaaataagtggctgccgtggttggccgtctttctctggctcacttcaccttgttgccctcggataactccagtgaactccttcttacttttcaaggccatggctcttccaagcaacctccctgagccccttgggctgggtcaggagggttccccaggcctgcatggacctacaatgtgctactgaaatgatcatttatgtgtctgtctctttctctaaacagtgggctcccccagactgggcacaaagttatttacctaatgtagccaagaggtaggtgtgcaagaattgttttctgttgagatgaaaatcaccaagcctggtcatttgctttctgtgtagacagcagtgtgttgttcacttaggactctgctctctgtctcgtgcaacttaccctttatttagggaaaatgaacaatctgtaaacaataagagaacactggcaaatcaatacagtcaagacctgtgggaaaatgtagaggtgtcaagagtaagagaataagctgagggagcaggtgtggatcaccatggtctcctttgacttgctcaataaagaccctctgaccaaaggttagctgcaaacgcctttgttttggagggctagtatgcagtggtttcgtgatgtgtcttttatatggtctcatggttttcaatttcttaattgatgtttctgatttacctgaaagctttaaatgttcatgatcttggcttggtacacattagacattaaggtttacaaccgatgcctgtcattgccatttgaatgtgttggtgacattcctggtgtggcaagctaggcgagtgtgcccccatcgacaaaagaggctgaattctatattctgcactatatggactgcctttctctttcactcacttgctttttaaatgacacaattcatcccattcttaatgggggttgggggagaaaggaagaaggaaacgaaagcaagcaaaagaaccactcagtgcccgcaactgttattatgatcttggtatatagctctaaatactttcaaaaatatacttgaaatactttcataggttttacaacaaataggattatacaaccaattttatcacagtgaatttccaagtcaataactgcttttcagactatgttccaaggaggggccggggttgcccagctcaagagaacaggaatccctgcaaagggccaggggcccgtcagtggctcctcctcagtgcagctctgctctctcggtttttttattgatacataatagaggtacatattttgggggtgcatgtgataatttaatacgttcatatcattgtaaagatccaattggtgtcattgggatacccattaccttaaatatttcccctttctttatgctagaaacatttgagttcttctgttctagctattttgaaatatacaatagattattgtaaactgtagtcacctactgatctgtcaaacagtaggtccttttttttttttttttgagatggagtctcgccctgtcacccagtctggagtgcagtggcatgatctcagctcactgcaacctctgcctcccgggttcaagtcattctcctgcctcagcctcccgagtggctgggactacaggtgcccgccaccacatctggctaattttttgtatttttagtagagatggggtttcaccacattagccaagatggtcttgatctcctgacctcgtgatccacctgcctcagcctcccaaagtgctgggattacaggcgtgagccactgctcctggcttttttttgttgttgtttttttttttttggagtctcactctgtcgcctgggctggagtgcaatggtgcgatcttggctcactgcaacctccacctccctggttccagtgattctcctgcctcagcctcccgagtagctggaattacaggcatgcgccatcatgcctggcttattttttgcatttttagtagagatggggtttcaccatgttggccaggctggtcttgaactcctgacttcaggtgatccgcctgccttggcctcccaaagtgctgggattacagacgtgagccaccgcacgcagcctcaaacactgggtcttatttcttctagcacactgtatacttgtacccactaaacaacttctcttcgtctcccatccccgctgcccatcccagcctctggtaaccacccatctactctctgtcttcaccaactccacttgtttagttcccaaatatgagtgagaacgtgtgatatttgtctttctgtgcctggttcatttcacttcccataatgacctctagttccatgcatgttgtacagctcttctctcattggaatatattttgtaaaacaaacaaaaaaaaattgggggtatgaaaggttttcactgctcatataaatgacaacttgtaaactactgtgaatagcaatattttcattgagtagagtgctaccaatatgcccattcagaatgaaaaactctgacaaacagctctgtccgtatatccttatcactcactgacaatcttttgattggcactggagcacccatctgctgggttttgtggagactgtggccatctctgccttttagactgagctgctcagacagttgacccaacaccggctgcctccttgccactgaatcggaatgaggtcatacttgtacatgcttcttggaaggttttcaggcctcagctctactgagcgaagacttggttgagtaacaagtgaggaggaaactgtagggttccattgtttacaatggggacagcctgcggcaccactagacattctgaggcgggtcctggttgggggtcagaaggtcattggataggcgggaaaaaaaatcattgcaaggttatgattgcaccagtgcattccagcctgggcgacagagccagactccatctcttacaaataaatcagaggaatgggagaaaatatttacaaatcatgcatttgatatttctccaatcatataccggtggccaataagcacacgaaaagatgcttaacatcattagtcattaggaaaatgcaaataaaaaccacaatgagatgccacttcaaaccgtctgggatgactataatcaaaaagacagatcgtgcattgggggcattttgagcattggtgaggatgtggagaagctggaacagtctatacgttgtttgtgggaatgtaaaacagggcagccgctgtggcacagtctggctgttcctcaaaagcttaaacacagagttaccaaatgatctaacaattccattcttagggatatacccaagagaactgaaaacatacatccacacaaacattagtacacgaatgttcatggcagcgttagtcaaaatagccaaaatggaggaagtaacccaaaggtctatccctgatgcatgaataaacaatgtggtgtatttgcacaatggaaagttattcgccacaaaaaggaataaagtgctgatgcatgctgccatgtggatggaccttgtaaacgttctggtagctgaaataagccagatacaaaaggccacatatagtaaactgcgtttatatgaaatgtccaaaataggcaaaactatagagacagaaaatacatttgtggttgcctagaactgggggtgttgagtgagacgaggagtgagtgttaaagggtgtgagtgaggaagatattccgtgttccatgatgattacatcattacatgcatagtgattgcacaactctgtgaatatatgaaaaatcacttagctgtatacttatggtgagctttatgttatgtgaattttatctcaatattaattttaaaatccaatgaagggcaaatttatattgtttttggcttttaagaaactgtcttaaaagacacatttatttatttatttatttatttatttatttacttacttacttacttacttacttgagacagggtcttgctctgtcacccaggctgaagtgcagtggcgtgaccttggctcactgcagccttgacctcccgggctcaagtgatgctcacacctcagcctcccgagtagttgagaccacagacacatgccatcatgcccagcgattttttgtagacatggggtttcaccatgttgcccaggctggtctgaactcttgggctcaagtgatccgcctgccttagcctcccaaagtgctgggattacagacgagagccaccgcacctggccaccccttttatactttgttaatggagaagtaaataaacagccagggtgtaaacaatacatgcacccccatagttcaaagggacaatggagcatatgtgttgatgtgtctgagaaaaacagaaaaaatgcttgtccctggaatgatggaaagaattgttacaccttgagaggagaggtcaagggtggaagtctgaaacaggtgtgggagatgatatttctaagagtgagccagtacgtttctggcaaaataaagactttagcaggctactagtttgtaaaaattaaactgcaaaactggagctggtttcacccttattttttaattatgtgggattagtcatttgtgcttgatgctccctcttagctcagccccatttctcttttctaaataaaaaacacttggttctaaatcctggcttagaaagcatatttttgaagctcaagacagaaaattcatttgtttgtgcattcagcaaatacttttcaagcatgcactgtgtgccgggcactgtcccaggcacctgagacacactggggaaccaagacgaagattcctgccttcaggcagcttagatcctggtgggggtgggggataggaaggggcagagacagatcatccaccacaaacacagtaggttagtcaatcctgtggcagattggaaggtgataaatgctatggagaaaaaagaacaaggtagcgcaggtacggaagtggaatggtgcaggtggcatgagtagccagggtccataacatggtgagatttgggcagaggcatagaggaagtgggggagctgaaccaagcaggtgtctggatatctctgagggaaaagcattcccagcagagggaacagcaaggttaaaggtttgaagggagagcgggcctgtcatgttcaaggaacagcaaggagtccaggttggctggaaaagagaccgaatggtagcagagcaagtcggggaagtctcaggagggtcagagtctatagggcctaggaggccattgtaagtacttggcctttttaacaatttaaatgtaattcatataccataatatttgcccctttgaggcatataatttactggtttttagtctagtcatcatactgtgcaagcagaacattttcttcaccccaaaaataaactttataccataaacacacacccacacacgtccctcttccagccgctggcacccactcatcaacattctggctctacggacttgcctattctggacatttcatattaatggaatcatacaatacgtgaacttctgtgtctgctttctttcacgtcacataatggtttcaaagtccatccatgttgtaacaaacattattagcacctattcctttctgtgtctgactagtattccatggtatggatagaccagtttttggtgatgcattcatcagtggatggacatctgggttttcccacgtttggctgttgtgagtgatgctgtgatgaacgttcatatccacgtttctgtgggggtgtgtttttctttcttgggtgtctgccgaggagtggaaggacttgagcattgcttttctcctgtgtgaaatgggaaccatcgcagtgttttcaccaggatctgactcgcatttttttttttttttgagacggagtcttgctctgtcgcccaggctggagtgcggtggcgcgatctcggctcactgcaagctccgcctcccgggttcacgccattctcctgcctcagcctcccgagtagctgggactacaccacgtctggctaattttttatatttgtagtacagatggggtttcaccgtgttagccaggatggtctcgatctcctgacttgtggtccacccgtatcggcctcccaaagtgctgggatgacaggcgtgagccaccgcgcccggccctgacttgcattttaaaagggtcgctttggctgcctgttgggtatcgactgtgggtgaacagtgagtagcaggaaggaaaccaggcaggatgtgatggcagcgacgtgggtgagagtggtgatggatcagaccagggtgggagcagtgaaggggttgacagattctggatgtattttgaagatagccaataaaattcttgattactgtgagagaaagtaaggttgtgagaatcagcccgaggattttggcataacctgttggaaagatggagctgccattaaatgagatggggaggggtcctgagggatcaggagcgcagctgaatgcaccgaggtggagatgcctactagacatcaagaggagacgtccagcagagggctggatggatgagtctggaattcaggaagcagcctgggctgcagatataaatttgggaatcattggcatctagatggcatttagaaccctgtaactgagtaagatcactaaggctcccatttattcaaaggacaaaacaacataaatgttgacagagagtaataatcttttctatttattgagttccaacagtgagctcctgttatcactaaaaacagacatcgcagataagcttctccagaaatacatatttcaacctggttgagctataggcacccagggtatatctacagaagccaggtattaatatcttagaggcatatgcatcaatatcgtgtgaagtcttttttgttagctcttttctgattatgctttcagagtttttttgttgttgttgttatatttttgttctcccatgtataccttggtttgtgatcagtgtgtaaaggaggaggaatggttgtttggttgagacatttgcaaatagtaagcagtcaccttacctaacttggctaatttgcattgtttccatacagagaatgtagtttgacagtcaaggatgatagaaagtcagaggatgatagaaaacaatcctttcttcatacagattaagaagaagaaatgaataatctaaagaaagaaataacaacaagagacagatgggatgctgactggtccagaaaccgtcaggtagcaacagttgcaaatctgagggagttcagcctggagaagaccaaggggagagagtagaaaggatactcaaatatttgaaaggacacaggcttcttttctgttgctctatatagaactaggattcgtggataaggattgcaaatagacaaatttccacttaaataagaaaaaactttcaaataattaaagctgcccggccaggtgcagtggctcacacttataatcccaacactttgggaggctgaggcaggtggatcgcttgagcccaggagtttaggaccagcctgggcaacatggcgtgaccctgtctctccaaacaaacaaacaaacaacaaacaaaaaactagcctagtgtggtagcatgcacctgtagtccgagctacttgggaggctgatgagggaggatcacttgagcctgggaagtcagggctgcagtgagccatgaccgtgccactgcactccagcctgagcaacaaagaccctgtctcgggggggaggaaagaaaaaaaactgccgaactacatgcagggtgggattgggcatggtacctgggccagcctgttggcataacatgtggaagcgggtgacccacagtcaggggtcagtctgagggactgccatactgggctagggcctctgagtgctctgccagcttaggggttccatgattctcagcagatttccagcaggtgtttgagggtttctgcattcagtgacataaacaggccctcgtgcttctgtgggttataggccagcttggtaccgtataaccagtacatcaagagttgaagtgttgcactaatgctttccaagagtcagagctggcagagtgaccgggtatacaggcagagtttgtactctttccttttagaaacacactctgctgtctgtacctgaattgttctcactctgtggaggacttgggattcttgatgttatttatcttatgtgttccaagtgctaagtagtttaatcctaatacttttaaaatgttaaaaaaaaaaaaaaaagagagagagaaatgtttaaagtttggatagaaacccttagaatcattaaatattctcagtgaaagggaccacagaggtcatctgggcccatttcctcattttatagaaaaggagtctgcaagatccagacagcagttcacccagattagttggttgattcaaactttcccttcctatttctctctacagtgttttatctacaattatattatatttaagatttggcaacaatgaccatatgagaagtccttgtaatatgccaggcactgtgctggccgtgcgttgtgcgtgcattttcctatttaaaatgccacctataagtgccatctttggaatatttgtcctttagaaagaagcatctgcttcaaaccaatggcagagacaaaatggcttttctcttatctttactactgtgtggatttctccataaacaagaactggcaaagggcctcataacagctctgtggccctctctgggctcagagaatgcccgtagccaccagcccagctggcaacaaatggttgcaggttctgtttccatgtttcagtcaatctgtctagagaacaatggaactcctgaaccattcccgtgctcaaatgtaacgtaaaaaggacaatataaaatatcaggcttctgtgtttgaactgctcccctggggaaaggagcatggtggttgggaactcagcattaaacaaggaaactcgatgtgtatccagcatcactgagtgctcaggtctgcagactgcagagagatgtaatgcttattcctgttcccacatctttgatctttttgcgtgaagctaatatttgagaattctttatttccctggagtgtcaaacctcctgtcaactcgccataaagacaaggaagagatttcctttttcaacaagtgaggacagatgtggccaagcgttgattattattgtaagagatgaatacaaatgttatcattactgagtgctaagctttgtttatttcttcagaattcccctagtgcctctgggctgggaatctcacccacagaccttgatcaatgtcccctggcactttgaacagtccttggttggacctgacagcacgctccagtcttacctttcactggtagcacagcagcgtctaaccgatagggactcttcttggctctgtgtgtacttttaccatcctagataatgaagaccagagccaaggaagagaaagataacaaacgagagagcatatttgattctaggagatttgactgaagatggagatggtcaggtaggcaattcaatggggaaagacacttattttttatttattgacttattttttgatacagagtcttgctctgtcacccaggctggagtgcagtggcacgatctcggctccctgcaacctctgcctcctgagttcaagccattctcctgcctcagccttcctagtagctgggactgcaggtgcgcaccaccatgcctggctaatttttgcatttttagtagacggggtttcaccatattgtccaaggtggtctcgaactcctgacctcgtgatcctcccgcctcagcctcccaaagtgctgggattacaggcatgagccaccatgcctggtcaagacactgatttttaagtaagaccttccaatgagtaatcctttataatcaacattagaactagacgagtattcagaaatgcatgttgttttatatgataacacaaaggactgaatacaaacatcattaaccaagctcttctgagagcttggggaaaaagctgcccgagggtaccctgctttgtgtgcatgtgatatgttccatctgcctgaaatgttcctttgaaataagaagcgagggcacagctgggtaggagagggttgggaaggggcccatggaggactcacctcactgatgtgctgtggaggttcgatgaatacattccccgcttccctcctacccagtgtggcctgatgatcacgactagtgttcctaccagtgaatggttcaccccgaggcaaatgcgttccctaaggaagatatgtgctgtgagtttccagttgtaagaagccagtggagacacccaggtagtctgtgttgttgaagcctcacgatctgggagggcggtgtgatgaatcccgggcagccacacacagtttccggcaataccacatttcatcaattccgtgttagaacattgagtccaagctgttggaaaaagcttccccttcaggtgtgaggaggcccaggcagcagatgccaggactcacactcctgggcatcatttattttggaagttggggaagcaggtgccggacaaagctctgggtcgtcttcttttgcatcccctccagatctcacagggtttcatgggtgccctgtgtttgatgttcagtgtggaatccaagagcctggtgaggagaagctgtctcagaaccagtcacaataaaaataatgatccacagttaacatgcatagagcatttgctttgtctcaaggcatgtgctgggtgcaccattttcatcctcacgggttctgctagtgtcctcatgcatagatgaggaaaacaaagcttagagaggtcaaaagagctgtccgaggtcacccagctggggttgcaatccaggtctgcctgaccccagagctccagctctgaacctctgtgcttcctgacctggcttcagtgcctgtgagtgtcacagtctcaccacagctggtgttaccatagctacttaacagctggtgttgggggagcggggaaagtgcagaaatgaagtttgcgttgttaacaagaaattttgctaattaattttggggggacacattgagcaagtccgcccaggtgcatgttcccacggtcccattccagtgggcagttgaatgcacacgtatgcatgaagggcgtgggtagtgaacttgtaacagcagaggaagcagaaggttaaaaggagaagctaaatacacctcagtgctggaacgttcattttgcagatttttgtcaggtttggcagagaaacctccaagctctaatcttacagggcgactacttgggaatcaatcgggaagcatatttcctgttactttagtgtagcgaaggcttctcctcgttcttttctactcttagtaatgtattagtaaaatgtgtttatgaaaatctgagtttcctcattccacctttatgtttttccttatgtctttataaaatctgtaagttagtttcctcattccacatttatgtttttcctcattctaatgccctctcttgaattgttagttctttgctttaatgacgctttgttaggcctgggctgatcccacgccatttttttatttcttctggtttgatttctgcttacacctcaaagatgtttaccttcatatcttctctttccctttacctgtgacctctctgccttgcctctcttaataagtgttaataatgctgggttacactttaactcactttgggcagtattctaaatcttaatctcttcaaaggaagtgctaatgaaatgtcccaccattatgtatctgtgttctcttacaaatgcagatgaagagccattcaatggagccacataactgcctttcccatcaagccttgaactgcaagtaaaggggcctgattgtgaggagtcagactcaccatctaggtcgcctgacagaggcccctcctaaccctgtccctggacactgtaacttctctaagacatttgatggtgaccaggcactccactcgtccatgtagtttctgggatggattcctctctggaatattagactgcctcacagattaaactgctaaaggaattttgcagcaaaatgaaatagattttggagcattgtttggagattggagatttggactttgttccaaattgcagatttggagattgttccaacaatttggagctgcttctcctccttcttctccttctccttcttctttcttctttcctcctcctccttctcctcttcctcttcttcttcttcttcttcatattattattattattattattattattcttttaattcttcaaaggagaagctcccaagagagtcgatttgtgtgagagggcctgtgactgggcccctgagagttgcttttttttgaattaactgggataacaaaagacaagcaggcatcttggtattttaagtgtgttttcccaatggaaatagaaataaacacaacactgaccaagtattcaacagagggatggctaaacaaactgtggggtatacatggaatagaatattattcagcaatgaaaaaggaatgtcattctgacacatgctacaacatggatgaaccttgaagacattctactaagaagccaggcacaaaaaggccaataatatataaatccacttaaataggggacctagaataggcaaattcatgcagacagaaatagtgattaccaggggatgtggggagggagaatgggtagttaatatttaatgggtacagagcttcagtttgggatatgaaaaagttgtggaacttgatagtggtgatggttgcaagacattgtgaatgcacttaatgccactgaattatacacttaaagatggttaaaatggtaagttttatgctatattcctagcatcattttttttttttttttgagacaaagtttcgctctgtcacccaggctggagtgcaatggcgtgatctcggctcactgcaacctccacctcccaggctcatgtgattctcctgccccagcctcccaagtacctgggattacaggcgcctgccaccactcctggctaacttttgtatttttagtagagacggggtttcgccatgttggccaggctggtctcagactcctgacctcaagtgatctgcccgcctcggcctcccagagtgctgggattacaggcgtgagccaccgtgcctggccttcaaaagtttttaaatgctgcatgtgaaggtaaccttaggagaaaactcttctgcttcttataaactggcgatgctgtgtagccgttttctgtgatcccagagcctgcagggcaaggctttcagagggcacacggtgccctttcacacgagtgatgctgacattttctccagagctgtgatgaataaataaatgaaggaaggagttaagattccttactactttgcatcttggtcaatagtcagtttgtcttctggttaaatatgagtatttttcgtggtggcaaccccgtcctccagctgctattcttacatatactggcatttacttaagtgagccctcttttcaaacaggacctgacctttcctaaaggagctttaaagaaatccatatttcctgattacaaatagaaaacagtgtgctttctcaagggttaatgtgggcaaagcaaagcaatgttggttctaatttaagcacatagtctttaggcttctttcgtaatagttcccttttgtccatttgggctgaaactgcttcagtaagcattttatgaaatcagtgagaaactccagaaaaaggcttctgcctctttttacgagggtcgtatttggagcaaaggagggaagaaaagcatctgtcaatttgataaatcattttcaggaaagaagaagtttcagcaaagtataagatagagttggcaatttaagggaggaaaaaaaaaagagaggagaccatcacatatagtgctatataaatggtttctatagagagcttttaaatatgtaaaataatttcatatatactatctcattagtgctcacggcaatccagtagttattatagagcttttaaatacgtaagataatttcatacatattatctcatttagtgctcacagcaatccagtaaagtagttattactttatgggtgaagaaatgaaggttcagctttattttatttcattatttattttacattttttattttaattaaatttttttttgggacgaggtctcgctctgtcacccaggctggagtgtagtagcaacaatcacagctcactgcagcctcggcctcccaggctcaagccatcctctcgcctcagtctcccaagtagctggaaccacaggcacatgccatcatgcctggctaacgtttccactttttgcagagacagggtctcgctgtgttgcccaggctgtggttcagctttaataagtggcttgctcaaggcctcacagcctgtaaaagaaactaaacttttgcagagcttccttcctgtccatagaactgtcccaaagtcggacgtcctgggcctgaggcacgggtttgtcacaaggggtggctcccaatagtaaaccttcatggctccctgtatgtgtggaatgagtctctaattgtggagaattgagaatggggggggtggttagagtcccttgaagtgttttgccagtgtagcttgtgtcgtgatacctctttgtgtcattgtaagtatgatcatgcccacatctttctgacatggtcttttgcatctgaatttgcagtttcacatttaacagatttaaacagattggtggcccatatgtatctaaaagagaaacatgtcatctccaggaccaactatatcatttgcagggctcagtgcaaaatgaaacagagggactctagctcaaaaatgattaaaagtgtcaatgtagcaacagcagagtaggcaaccaagcacagggcctacgtgctggccagtactctagcctggaaaagtgcaagaccttctgcaggtggaagcttcacagtgtgccttcagggtctgcttttgggctttctgccaatctggctacatacttaccctttgacacaatcaagggcaaagagttaaaggaaaggtagtcttgaggcctgaactctcttctaaccctattttttttcttcttttgagacagggtctcagtccatttgcccaggctggagtgcagtgacacaatctcagctcactgcagcctggacctcggctcaggtgattctcctacctacgcctcccgagtagctaggactacaggcacatgtcaccacatccagctaatttttttttttttttttgagacaagagtctcgctctgtctcatttgcatttgcatttcagacgcgccaggctggagtacagtggcgcgatatcggctcactgcaacctctgcctcccaggttcaagcaatcctcctgcctcagcctcctgagaagctgggattataggcgcctgccaccatgcccagctaattttgtatttttagtagagatgaggcttctccaagtcggccacgttggtctcgaacttctgacctcaggtgatccacccacctcagcctgccaaagtgctgggattacaggcatgagctgccacgcccggccatgtatctttttaagtacaggtggaggtctcattatgttgcacaggctggtttcaaactcctggactcaagccatctgcccatcttggcctcccaaagcactgagattaccagcgtgagccaccacactggccaacccagactttccactggtacactgtcttcattgctttgatagcaacttttaggctcccttagctttaaaaaagaatcctctaaccatatggggaaaaaaaaaaatcagcaacaactttgtacccacctgacattcggccagaatttttccaacagaacctaacaatagatatgctctctgaaaactctacccagatcgtacactccttgctgggtaggattgtttcagaggatatgaaggacaagggactgagccatgacacctgtcacttcccgtctgagcagttcctgaagaaacagcccccggggaatgaactaccccctctgcctcggggacaggcacctcctggtccacatccatccctggaattagatcggagccacagatgctatcactcctctgccgtggccccatcctcctctgtctggcttttgatgaactgaagactggggtccgggttgtaatggagacttagagttgagtgaagcattttagctttaagaagattattataattatctcaaggcactgaagggctgcttcatttgcatttcagacactaaaatcagagggcagatctttaagaggttaattttgtgagtgagtccttaataacagagggaccaagactcgattctttatgccttaggctaggtttgcagttggtagatgcaaaatatgctgataagattaaagctcctctagtgactcttaagcctcaggctcttttatttgcaaatgtcctgcaccctccatctcagagaactctctaggctccggtactctagaatcccttacagtggatttgcatggacaggaaagcgaattctcatctcttccaatcactgcaagacatggaacggatagtctggcggcacgtctggcagctgaacctcttcactgagaatctaggtaaaggccacttactgatcattataaatgcgctcatcataaagcagtccttctggatttctggcattttcttgaataaacttattgaaacaccctaaggagaactcagacatccttttcaaccctcaggagcggataagaggatgcagcttcatttgttaaattgcagttgcatgtcagttatgaataaacatggactggacttctgatgctaatgtaggaacgatatttgtacctcctggaagtaactcctatagctcgttttcttttaaaattatgcaatccacagtcaagtcctggggtacaagtctaagaggcgtcagccacacaagaggctaaagtgactttggggtagtctgcaagtatctcaacctgtcatttctccagacattcagatatagtacattttaaacacagcactgcctttttcttgaaatatttagtttcagtgttagctaagtttgtgattttttaatgcagaaaaaatgatttatttttaatttctgattcctcgtcgggctatgtatatgtaaagtccagggttatgagaaggcagaagtaaacttgctgggtagaaggcgtcatggtatcatgtgatgtggcttagattaatatgggccagaacactttctctttagacattgctaatgttattcttattcttctactattcacaataatagctaacatttactgagtgcttacagtgtgcttggaactttgctgagaactttataccaattatctgagttttacagaaacattttaaggtagatattgttaatatcccaatttgacagaaggaagaaacaggagttctgggcaggtaaggaacatgcccaagcattgctcactaataaatgactgagctgtgtgtaaacatagttctttccacgtccaaagcccatacttgtaaccactgcactgctgtttgtagatttgttcgactcctcagagcagtaagtcagtttcatcttacttgcctggcctctccattgagtattgaacttggcaggaaatagtgttgggagtgatttgtgatgtctgagataggtagatccagtacagaggaatgttgaaattagacttactagtcccatattagattcttctcagactatccacgagagacttctccatggacccaataccaaccaagcttctgtagaacattttttttttttttttttttttttgagacagagtcttgctctgtcaccaggctggagtgcagtggcgcgatctcggctcactgcaacctccgcctcccgggttcaagtgattctcctgcctcagcctcttgagtacctgggactacaggcgcacaccaccacgtccagctaattttttgtatttttactagagacagggtttcaccatgttggctgggatggtctcgatctcctgacctcgtgatccacccacctcagccacccaaagtgctggaattacaggcgtgagccaccgcacctggcctgtagaacacatttttattatgcagtccatgttcatatgtctagcctgtcagtgggttacttgttaataaaaagcagccgtttcatattagtgtctcattgaaagcagtgcctgttttccattcattctaccttggatttgttttcttcctcaatactgaattcttagaaaatgatatgtatgttgaaaaatacttgagaatacctgagaacggttctctgttgcatttattgctgtatgtgaacctgtctatcaagaatcccaggtgttttgtgatttccgtgtttgtgaaatacattaactctccttatggttggagaaatcaaaacagtgcaggtaaatggtgttttgaaatatctgtaatagtagcgaataagtcagagcctcacagtgcttcattttttaatggaaaatttgaacacatacccacctcttcagtactgaagaattttttcctgtttgattttgttgctgagattggagtttgtcccatgagaaatcactgaacagatttaattttgtttattcttttttttttaagacagcatatttgttctctaccaatatcatccaaagaatgaaatgaatttcaaccagagatgtaggacctaaaaaatttaggtcaaagcttacatataagtggctttgtcttgctggcatcagtattttcgtatttctcttctcaaaagaagataactttatatcaatatttcagaattccatgtagcccaccctactgactgcattgttgtctgttatgctgatacaaagatcttttgttttccttgcctgggatgttctgccatatctcagatggctggatggacacaggtggcctaaaattcctgtgccagattcagcatgatcctgacctaacttggcctggatcataaagtaaaccttggggaatgttcccgtagcctgagcgggaaacactggcctctgggagctccttatggaggagagaaaacgaggagctgtaaactggacaatggattaaaactctagtaaactggctggggtgcagtgtctcacgcctatcatctcagcacttcgggaggccgaggtgggtggatcaactgaggtcaggagctcgacaccagcctggccaacatagtgaaaccccatctctactaaaaatacaaaaattacccaggcgtggtggcgggtgcctgtaatcccagctactcagggggctgaggtgggagaaccacttgaacctgggaggtggaggttgcagtgagccaggatccttccactgcactctagcctgggcaacagagcagataatctcaaaagaaaaaaaaaaaatctggtaaactgaattccgggtcagatcttcagatcttacctcctgtgtaaccttggctaagttaccaaatttctcttcacctcagtttctctgactgtaaaatggagacacaagccagaaaatctttaagttcctgccaagttttaagagtttgaagcttccacgatactctgtgcccaggcccttcctgatgtctgcttttacagcgggacaagcagcaatgctgttgtactctctgcatcttggggcttgttcctctgaacccttgaagacaagggctgagccgcgtcagctctttcccaaaacacaatttaaacccttcggagtggtcagaaatgccactttgggaggcctccctgggttctctgggtgttttgttgaagcagtctcaggttctctaacgttctttttgttgaagatgatatctacaagctttataagctttcttctgatggggagagggaagaggttctcttaaatacagtgttcaactatcaaccgtcatctttagggagacccttcaataacctcagtttctctttgtgtataactagagctaataagagaatgtgggtaaattgggctaaaacaaagccaacattacagtagttcacatgatatttttaaaagaaaaacaaaggcggcacgccagactaaataaggctaccatggccaccgaagttttgcatcaatttgtgaccaaaggacatttttcaaactgacctaagccaatttggtatctgcagttatttttggtcaatatcattagcctcccatagttcaaagtaggtggggctataggttttctcctacaaaaccttgtttccaggtcatgttacaaaggaaataagtcttttatttttatttttatttttggagatggagtcttgctctgtcgcccaggctggagtgcagtggcgtgatcttggctcactgcaacctctgcctcccgggttcaagcgattctcctgcctcagcctcctgagtagctgggactacaggcgcgccccaccacatctggctaatttttatatttgtagtagagacggggtttcatcatgttggccaggatggtcttgatctcctgacctcgtcatccacctgcctcggcttcccaaagtgctgggattacaggtgtgaaccactgtgcctggacaggaaataagtcttaaaccaaattctgccatacttacaaacgtgtagcaagctgacaggaaaagtcctacaattcgttttgtaaacttgatgaaaagccacgcccctatccttttaggcaatcctacagcattttacataaagggtaccctagaggcaagtgcggttattgcactaatggcatgagccagataatcatccagttagtcaagcagagaaaagtgctcctggaatgacctgaacaatggaccaatcagttcaaatccctaatttgattaattgggcttgctggattttatacaagcaagaatgcctgctcaatatttctagccaatcactatatcttgaacataaccattttcaccaaagaaaaataatttctaactgccatgattccagttaaactctgccgttgaccagtaatagagatagccaaggcagcgtggcaacggcctttggagtgtaaccttctgatgagactctcagatgataacttggactggcctaggcactgagcaatcagaacagattctggcctcagctgatgctgtgcagaagcttcctactgagccagaattgtctcagagagctgccaaggcaaccaggtcttgagtggccaagatctgagatagaagggaactatagagagtggagaaggtgcttttctctccctgttcatctgctgagaaggcagcagaacttttggcagtataatgaggcttaaaagacaaaatttgggattcagacctgccaaggcggacaagacttaagagatcaagatcctgggaggaagagacagaaaagtgaactggatactccagtcgttgtcccctttgaagcatttgccaaatattagactgtatactgcaagagactaagcaaaaaaaccatttttagtggagttctcagtatcacagtgctaagtggaaaaaaaaaaatcacatggcggggtgcggtggcttatgcctgtaatcccagcactttgggaggccgaggtgggtggatcacctgaggtcaggagtttgagaccagccatcaccaacatggtgaaaccccgtctctactaaaaatacagaaacttagctgggcatggtggtgggagcctgtaatcccagatactcgggagactgaggcaggagaatcacttgaacctgggaggcggaggttacagtgagccaagattgtgccattgcactccaccctgggcaacaagaccaaaactctgtctcaaacaaacaaacaaacaaaaaacaatcacattcaaagcttagccaggagaaaaggcgctaggagataccccactgggatccttgaagaatcataacctaaaaatagatgtgaacctgaagtagacaagcgatacaaaatctcagtgagctcagtctgggattggtttagcttgatcactcccattcagctgcctaccagaggactgggcgaacgatcactgaagaaagatgggagtctctacctttctcataagttgtttcaatgaaaaatgatcaagcataccaagaaataagcctaaaagaaaaaaaataggcactggaaagatacccataatttactggcattatcagacataaatttcaaaatatctgtgattcatatgttcaggaagataaatgatacaataaagaatttcaccagaaaatgggaattcataaaaagaaactggggccaggcgtggtggctcacacctgtgtaatcacagcattttgggaggctgagttgggcagatgacttgatcccaggagtccaagaccagcctaggcaacacggtgaaactctgtctctataaaaaatacaaaaattagccaggcatggtggcgcacacctgtagtcccagctacttgggaggctgaggtgggaggatcacctgagcctgggaggtcaaggttgcagtgagtcaacttcacttcagcctgagtgacagagatcctgtctcacaaaagagaaaagaaaagaaaagaaataaagaaaagaaaagaaagaggaaattctggaacttaaaaaatgaaataatggatattaagaacacaacaagtggatctaatagcagattagatttagtacaagacagattcagtgaaatggaatgcaaatcagttgaaaatatccagagagatacatggagaacaaaaaggatcaaaatacagaaaagagcagaagagacatatggaacacatgtaacatataattgaaggcctggaagaggggaagagggaatgaggcagaagcaatatatttttctttttctttttagttgacacataataattgtacatatttgtaggtacatatttataggatacaaagtgatgattttggtataggtgtacaatgtgtactgatcaaatcatggtaatcagcatatctatcaactcaaacatttatcatgtctttgtgttgtggacattgaaaatcttttcttctagctttttgaaaacatacaataaatcatcattaaccatattcacctgagagtgctgcaggatgccagaactccttcctcctacatagctataatttggtctatagtttggtatccattaatgaacctctccccatccacctctccttcctacctttctcagcctctaacacctaaaattctacttcaaaatgtgatttaagaagccctggcttgccccaaccaggatatacacagagaaaaccacagctgggtacaatgtagtaaaactgttgaaaacaaaagccaaggagaaaaatgattaaagccgtgagaaaaaaattcattatttttaaaggagcaacactaagacagtaactcatttctcaacagaaacaatggatgccaagagacaatggaacgtcatattcatgggttgaaagaatgtaaccgtcaacctaaaagtttacaaacttaataaagatattcgtcaaacattgaagtgaaataaagacatttcaggacaaaaattgaaagaatccatcatcagtagaccaacactaaaagaaatactaaaaggaagtatacggatagaaagaaaatgatcccagaaatgcaggaaggaatgaaagctgacagaaagggtcaacatgtggttaagttcaaatgtattaagaatatgagatgtattgatggctggatagagggatggataaatatgtgataaagtaaatgtagaaaaaattttcacatgcagaaatgtggaaaaattaaagaatctggatgaggggcatatgggccattctatttttgtaaaatgttcagaaaataaatatagggcaaatataaatgaacattgaccatataaaagaacaaaaatggggttttgtgggcactaaaatatatgtagcattaaatgcatgacaaaaacaatacaaaaagtgaaagggggtaaagggagttaaagtgtaataaaatcataacatctggaagtattaaaactcagaattttaccagactataataggtcaaggacacataatgtaatctgtagagcaactagtaaaataatgcataaaagggaaaatagaatgaaaaatacttgattaatctaaaataattcaagaaagaagaggaaagagaacataaactaggtggactaatagaaaacaactgtaagatggtagctataaactcaagtatatccgtaattgagttacatgaaaattgactaaatactctaattaaaagataattattgttagactgtattttaaagacaacaaaatctaattaaatactgcttataagagacgcttcataaatgtaaggacaaaaagaagttgaagataaaagaatgaaaaaaagatataccttgtaaatgccaaccaatataagctggcatagttctaatataagagaaaatagacttttcaagaatcatcatgaagtcaggagttcaagaccagcctgaccaacatggagaaaccccatctctactaaaaatacaaaattagctgggtgtggtggcgcatgtctgtaatcgcaactactcgggaggttgaggcaggagaattgcttgaaccctgggggtggaggttgctgagagccgagattgcaccattgcactccagcctgggcaacaagggtgaaactccatctcaaaaaaaaaaaaaaagataagtatctttaatttatcattaatgttaaatagccaaaaatatacagaattaaaagaagaaaccagtctgtaatcatagaaacaacatgtctctctcaaaaactgatagaacaggcagacaaaaaatcagttaggagagaagatctgaatctctcaacaatgacacaattcatttccaagtacaactgggacattaaccaaaattgaccatatgttggctcataaagcaattcttgacaaatttcaaaggactaaattcattcagagtactttttttttgaccagagagaaattaagctgtaaatcaatgaccataaaaatagaaaatcaccaaatgtttagaaattaagcattctacttgtaaataaccaacaggttaaagaagaaatttcagtggatttcagacaatagtttgaaatgaaatgatgaaaattttacacgtcaagcgctaactaaccactcacccctgaagtgtgtattcctaaggtacttcaaatattaaataactactcctataatgtaaattaataactaacccacacattattatactatgtatactgaaggactgttatttatttatttattttaagacagaatcttgccctgttgcccaggctggagtgcaatggcgtgatctcagctcactgcaacctccgcctcctgggttcaagtgattctcctgcctcagcctcctgagtagctgggattacaggcatgtgccaccacacccagctaatttttatatctttagtagagacagggtttcaccttgttggccaggctggtctcaaactcctgacctcgtgatctgcctgccttggcctcccaaagtgctgagatttattctatcatattatcattcatctcaaactccatatgtaacttgcagttgatttttcaacattcaaacatcatttattattatccatcaaattgccatcttgttccatttccctgcatatctcctttctgtgtagaagtcttccttctgggagcaggacgaggtaagtgagatgagagcctgggctgtcacactttatattctaatatttttaacccaatttgctttagtgtggtcagagaagctggaaattgaatcagagacctcaggggcaactcaggtgataagtcagcctggatgtgaagtttatcagtcttggctccgtgtgtttaattagaagctagtggaatgttatcattgactccgccagcaaacatcttcactggagaggcagctgggttaaggaagaacatgctgaaaatagagcttatgaacatagctgaaaactgtttatccacagcaaccagcagaagtgaggggcgggagagagcccagcagttggcaatcagagcgtgcatataagcaaagggatcatttcttccaagctgtgtcagagggcactcaatcatgtatactgagctttcttcctgaaaagatagttcaaatctgtgtggattgtcaagttttcttcctctccataatatggtcattaatatttcacttcttttagccaggaactttcaataattcaacatctgctcttccaggctgcctgcaagaaaggccagtttccacccactgccctcctgggtttgtccttccaggtacagaatctgagaggtactggggaaaagaggaggcaacgaggctagtctctcactcctctctcttccctacctgtgtttcttggacgggttcacattcttcttgcatcagatagtaaatgcagtcaaggaactggtgaggaaaatgggaagtttttttgtgcatgtgttagatgggaagaggaaaattggcaagtgttctttaagaaaagcagacacagttacattcatgaggcaaccggttgccagactagtgtgactcctgaaggaacaacttggattgcctttttttttaaaatcagtttttatctagaccaaatctcttttatttcagtgatgtcaagcagctcatgttaccttcgcccaaagagaaagatgtatgggagcttcaaactcaggacaattctcaatgtccttagcgttgactcatattaaaaatgttaagagaacactagaataatagtgatgtgtgtgtgtgtgtgtctgtgtgtgtttgtggtttcctttcctggaaaccctttctaggattaacctaggttaatccaacataatgatagtctgaagaggttgaataaatcagcccagatacgcaggtgatttagccaaggctacatggtgagtctaggggcaaagccgaataagggtggagtccctaattcatagctaacctgcactgccatagtctatcggaagtgaggtagagattattatctgattttattattccgggacacgtaaacttggctgaggacacacagctcggaaccctagcccatagataaatagacaactttatagagtataatttgagtaagccaaaaagtttccacttacatatattctagacctccactttaaagtaatttgagggggacagagaggcaaagtgagcagcatttcttcagaaatcacgttgtctggaaatagctcagtagtgcgcatggcactccgttagccaattgctgtcctgggcctggagggccatagagctggacagaggccttgttttgtttggttcggtttgtgcttgtggtattcaggctggtaggtctgatggctggtaaagtgctaaagcaatcatgggtgcgaggtacacagtggggaatgtatcaaacggtcactttcctaagggagacattctcccccttctaggaatttgctgagggttgggctgagtggaagcgtttccttcctgcctgttctctgacttccaatgcgcactttgttttaggctggatagctacacatcatcaatgagattgcagacagtccctgtgcttgctaagaacggtggaaggttttaggactactgtgtcttacatattcattgtctaagcccccaagtgtacagcattcaaagctattccttccagctctgaaatttctttgggtgaaagctgtcgactttccttagaggaaaaagaaagccatttcatcagggcactgacctcattcctgtaagcttgactggctgagccctgggagtgacacctgtcccagtctttggctttagcaagtgattgatttgaagaaatggtattggtcatttaacccacaaactgattctgaaataagactcatttgtaataaatacatctcacatttgaggactgaattcttcaacacacattccaagttttgtcagttagaaaaaatacagtactttgtaaagtataaaatccataactctatataacccaaacaataggttgaaaactgggtttgttgtaagtaacgtattaataacacctggtgtaatacctgttaacatgctcggtgcctgaagcaaattggcaagcgtttcatctccttttgccaataacttgtcagaaactgactgagggttccttccaaactctcagaagaacatccaaggccaggcagcttatgtagctcttgaacttcaccagggcgagggctgggccccggccaactagagaagccacagctgaatcagaggaggaattccgaagagctgggcaggggcctcctgatggcgagatgctgaatgggataagaatgtgatgaattaattgatttgtatcttacgcaagagctgcagtgaggatggtgaaattcatttccttccataggtcctgcccctttctttgtaagtcagtcagcagcattgccagagctgcctaaaatgccacctccatcccctgacaatcaaagaggaatcttttcatgcaggctgagttctaatgacgaactcattaaaatcaagaccacttactatgcgtatgtgatgtgttataagcactttcagatgcatgattttaaacattctggccatcctgtgaggtcagtaccatattatccccatttcgtggacagaacagtcgtttagagaacttcagtaatttactcgaggcaatctggtgtgaaaagtttgagagaggacactgcaaccaggccacctgggtccagatcttggccttgccacttacgagctatgtgaccttgagaaaaggtcttaacttctttgtgtttcaatgtccttatctgtagaataaggataatagtgttgcggatgtcacagagtcgtaatgagggttaaataagttgatatatagacagctccgagaacctggcctggcatatggtaaggactagctacttatttgtggtggtgatttgtttttactctgtgagagatttgaacccagtttagtttgatgctagggtcagagttctttgtcatctgttcttaagaagccagtggaataaatatcttctttctcctacatttacaaagagatgataatcctgctttagaagagttatcatgcctgcagaggtatcatagagattagtttttatccgcagagcactttttaattggaggataattgctacactggactagtgtggtagtaggaattcatatcaaaattagactttgtgactgaaagtgtaaacaaatgcattcttgctaagactagccacatatttagaggcatatagcagtctgaaataattctattcctttgtcaacacacagacggaggaccgttgggccttttgctaaatttggctctgctgcacttccgtctttagaactaggcaattgcttcatcatgcctacattgtgctaccctgatattttggtacctactgcactgccgcacattcatgggacgccagctgtaccatctatataataatctgagaacttggccattcaccatccaaagttttcatacaaaccaatgaaggcggcgtgcacttcagatgagcaaacaccagacctgtagtataggtggacagataactagattttgcttttctgataaaaaaggaatcttgtctgttgttttagaactactttatatggacagtgagtgcagcatgatttcttccaactggagatttaatggagacctggatcaaacattacatactttgttacatctttttgagaatgagttggagtgaggggatgttatgttgaaaaagaagaggcaggctgggaagggtggctcacacctgtaatcccagcactttgggaggccgaggtgggcagatcatgaggtcaagagtttgagaccagcctaaccaacatggtgaaaccctgtctctactaaaaatacaaaaattagctgggtgtattggcgcacgcctgtaatcccagctactcgggaggctgaggcaggagaattgcttgaacccaggagggggaggttgcagtgagccgagatcctgccactgcactccaacctggcaacagagcgagcaagattctgtctcaaaaaaaaaaaaaaaaaaaaagaagaagaagaggcaacacttgtcttggcaaaccatgactagtttagactgcaagctcaatgaagatcaaaactaggttggtcttgttttgtttcaggcactctctgtatgtatttgttgaatgaatgaatgaaaataatagttatgattataatattatctaagtatgaagaacatgcctctggatcagtaaagacacataaaatggtaggagggttaaagaacatcagtgggtaccaactgttttgtcatgacagggggatatctctgaaaaatttctgtattaattggaaaagaagcttatggtgaacttttttttttttttttcgagatggagtttcgctcttgttgcccaggctggagtgcaatggcgcgatctcagctcatcgcaatctctgcctctcgggttcaagtgattctccttcctcagcctcccgagtagctgggattacagacatgcgccaccaccccggctaattttgtatttttagtagagacggggtttctccatgttggtcaggctggtcttgaactcccgacctcaggtgatctgcccgcctcggcctcccaaagtgctgggattacagcgtgagccaccgcacccggccatggtgaactctttttaaatgacacataaaatttcctgatttgtcttttaaaagttacatctagattttcatgtatcatttttcttataaggatagctaattaatatatagattttatgtatggattttcatatttcatgtatataacatgaattaaactgttatttgtatgaagtgccaagctccttttgggtagtacctaccaccctgtatataccacatgccaaatgagtttttaagatattggcatgtcccaaattcaccatttacattcttgaaagtacttcctttgttccatacagatctaactaaatattagaggtatctgaccttttattttttgaaaaaatgtttgatgttctgactatttgcaacaaaagagctctgttctcaaatgccctgtatggagagaatttctcggttcttttgagagggataaaaaacctctcttaagtctgtgagactaaagataaagggcatcccagcaccatgtatctgagggataatgactgtccgtatcggagagctgggcggtgatgggtgtgttggaagcaccggctggaccaatggacttggagctagaacttggttttgctctcggcgttgccgcagggtggctgtcttgccttatgcaggttttgattctcttctgtaaggatctggtagctattccaaagccaacccatctgtgctatgggatttgatgccacatgactccagctaccctggtaggcctttcccaggcgttggtcagagatatgatccaaaggctgtctgtagaagattgttctctcctgagtgttctgatgcagccagcacaagggtttcctaaggaaaggaacctggtcctgcttcggtcgttttcgtatcccctaggggctgctgaataaagtactagttcccaagctttctgtcatatcttctctgcacacttctggagtagagtgggtgagggcaaggccaggaggtcagtgccacagcgtgggaagagaggaggccctgggccctattctctctggggagctttacatcacccattgctctctccatctccccagggcccagatggctccattctagagcttctcctccaaccccttcccaccttccatcccaaacactttcctctctccttcttggtctctctctctctctttctctgcccttccttccttccctccttccctccctccctcccttcctctctttctccctccctccttccctccttccctccttccctccctcccttcatgttttcctttcttccttctttctttttctttttttttgatacagggtcttgctctgttacccaggctgaagtgccacccctgtgatgcctagtggtacaaacactgctcactgcagtcttgacctcctgggctcaagcaatcttcctgcttcagtagctgggactgcaggtccacaccaccactcccagctagttttttaatttttttgtgcagatagtgtctcactatgttgcccaggctggtctcgaactccttgcctcaagagtcctcccatcttggcctcctgaagtgctgggattacaggtgtgagccactgtgcccagcctctctgctctttcccttccttctcctcttagttaaaattgtagccgtggtcagaggtggctctgtctcctcgtagaaagcagggagcaagactacaaaagaaatggtaaaattttaacgaattttaaatgaataaatccctaatttcctatggaatgacaaactaaatgatggtttgtagttggaaaattaagcaataaaatacttttttattttttgagagagagtctcgctctgtcacccaggctggagtgcaatggcacactcttggctcactgcaacctccgcctcccgggttcaagcgattctcctggctcagcctcccaagtagttgggattacaggcacgtgccaccatgcctggctaatttttgtattttagtagagacggggtttcaccatgttggccaggctgttctcgaactcatgacctcaagtgatccgcctgccttggcctccaaaagtgctgggattacagacatgagccactgcgcctcgcctatttttttttttttaataagtctataataggtatacacagggcctgactattccagatagtgtcagctgtgtagttttcttattagcagacttgggatctatatttatagacaattgaagttttaaagatgtaaagaatttatttattcattcatttattcttttgagagggagtcttgctctgtcgcccaggctggagtgctgtggcacaatcttggctcattgcaacctctacttcccaggttcagtgattctcctgcctcagcctcccaagtagctgggtttacaggtgcctgcaaccacgccctgctgatttttgtatttgtagtagagacggggtttcaccgtgttggccaggctggtcttgaactcctgacctcaggtgatccagccacctcagcctcccaaagttctgggattataggtatgagccactgcggctcatacataaagcattatatacaattgtcattatatactgtaatgtaccttcattccttctgtctgaacaatgtggattttagaaataattaccaaatataaacactactaaaatgtgtagatttggtggtgcagcacatcaaggagcacaaattttacaaatttctttttaaccatctctgcgttgtattttcagaatacggatgattcattttaatcctggtgtctttaaatgattaaggattttcatacatgaggtatttcccacagggaaattctaaggtaatttgggtatgattcgtttagagtttttcattatttacaacaatttagtaaccattagactttcttccttgcatgtgaatacatacatatatttttacatcaagtatttccatcgaattttagctgcttatattttctttttaaccattacttggaatggtattttcctataagcggggaataaagaaactacttctgtctctcgggtatattaacagggacagtggggcctaatttcttatgtcccctcagttagcctttgtcacagacactcctgtgttttggggtcaggagggaagagatcattgcagactacagtcatggaatttgattcatttaactgaaaactttttattttactttacccatcttaagtcctcctgatagccctataaagtaataaattgtccaaaccccttcaggaaactattcttaattccatcatcatttatagttgcctatctgcccaataaaccagaatttagccttaaagccatcgctctcttaatctgtattatgatcttgtctttatatatgagttttgtttttcaaattagtggatggccttaggtaccattttgttattctgcttgtttgtgtcttctgaagacagtcacagcatcatagaatactacagattggaggggtctatgggatcatcagaaccagtgcttttcaaaaaaattttaactgcaaactccccatttgaagtgaatttttgtttgtttgttttgtgacaaagtttcactcttgttgcccaggctggagtgcagtggcacaatctcagcccactgcaacctccacctcctgggttcaagcaattctcctgcctcagcctcccaagtagctgggattacaaccatgtaattacactcggctaaatttttttgtatttattagagattggctttcaccatgttgaccaggctggtcttgaactcctgagctcaggtgatccacccacgtcggcctcccaaggtgctgggattacaggcgtgagccacggtgcccagcctgaagtgaaatcttataagaccctcagtattggtccagggagggtagacttcctcatacctcccaggaggcccgagggctccattgcctctaatttcctctagatgagagaactgacacctctagagataaaattagctgcccaacattttggtgagggaggaagagtccatttttgttgcttagaagcttcgaaatcagcagaggtcagtgtatgtggagattgctggtaataagtctggaaacagagcagaaggttgcaggttggaacctggcttccctggaagccaacactcaggtggagctgggcatgcaggatgtttactggaaatccacacccgtagaaaccaggaggatgcaggattgtaccaaggaaaaagtcaaactgccacacaggccaacaaagccttggccagccccacagggaagcgctggagcataaatggcccatcctcgtgtcctgtgttggacttgatggctgggcctttataccctcactgctatcagtctttggatgtgaaccaccttgggaagggcaggcccttggccttctgcagcattctgtggctttcttcagtggaagcaaatcctgaagaagctgtcagctggaagccaattgcccacagctggggcaacaagtcctcccttgaagcaagatctagaaggcacatctccatgtcccctccacatggccccaggattgctggtgaacatgagagacagtggagaggagagtcccgggaggcagccttcccagccaggccaccccaaacttctggttagggattcccagcttcacagcactacgtaagctgcttgccaacagatgttttgacaacatctgttgtcaaaggttgacaacaacctttggtccttgcgatggctttctcctgtgtttcaagatggattcctattggcatctttcatttccacctctgtttcaccaagtttagtgaccattttcatacattggggcttaatgtggtgcagtggaaagtgtagcagattgaatgtggaagatcgggttccagatctcgttcaggaagttagtagctgtgtgaccaagagcaagtcgttcagcttttctgagccatgattcctcaggtgtacacaccaagtgatgaaacactttaaaaactaagaaaacagtgtttgaaatgcccctcaagtgctggtgtttccccaaggatgttctagacccttcaccattccattcattcattcattcattcatctattcgatgattagtgtgatccctaacttttttattgttgttgttgagacggagtctcgctctgtcgcccaggctggagtgcagtggcgcgatctcggctcactgcaagctccgcctcctgggttcacaccattctcctgcctcagcctcccaagtagctgtgactactggcgcccgccaccacgcccggctaattttttgtatttctagtagagatggggtttcaccgtgttagccaggatggtctcgatctccttacctcgtgatcctcccgcctcaacctccccaagtgctgtgtgatccttaacttttaatctacagttcctcttttttttttaagccaagtagatgggtgattttgttttctgctaattattttggtatctttcattccacctctgtttcaccaaatttagtgaccgttttcatacattggggctaaatgtggtggtcgttctccagaagagtgagtgtaagttcgctcttactttgagcagcttatctctgtttaggcgatttctttgtcaccattaatggaagtgtgacacctttctgagtcccaaatgtatcggtttatcaaaaaccacatctgcaatgctgcaccttgtactgagttcacctcagtctggtactttctttgccttttgtcttgtttgcctccttgttagattagctccttaaaactttttcttttcattttccactaagtcataactctctagactaaatcctattaaagaaacatttaaagtgtttctttactgtgaagtgtatcatgcatgaaaatagtgtgtgaaatggaggtagatgttcagtttaaagaccaatagtagagcaaacgtctatataccaactcctcaggttaagaaatcctcttgtgatatatttatgcacgtggagtagctactttttccagaatttggggacatgtaatgatgactgagagatcatatagtctacataaaacagctcatcatcctagaatgagaaagagagaaaccagccaataaagaagggcagtgtgtataggtacttacaatgagaaatacaaacaagatgggattggagccgttctctatgtctgggagagttagaaaagtttccaagaggatgagacttttgaaaagtttccaagaggatgagactttttaagggatggtttgcctgaggaagatgagcgttccaggtaaagggaacagcatagcacgtgtagtgattcttctccctcctcattcccctctcaccattctgaccattcaccttcagtttcgtttccactctcctatcctccataaatgttggtgttcccataggtgttgcattaggatctcttctcacgtcattcaattttcatccattcacttgctcaatgtcaatgaagcaatgggtctccagaaactcctgcctgcagaactatctgtggagcttggtaaaatgcagatggtcccaccagctcaatcagaatctttggggtagggtccaggtatctttagtgcagatgactgggactccacatggagaaacacaggtgaacagggagggttggagagaccactcaggaatcagtcacaggtgaccttgtgcttcctgctaccatggctgcccctcccagcctgcctcacctgtgcctttctcccttctcccttcctgccttcagctcctctgttgcttcttcttccttaaacatcttcaccggttcctgtgctattacagagccccgtctgtgggtctcatgtctctgctccatgccacgccctcccttgggcatcatctgggctttggctgggtctgtggagggtcctgggctgcagtgccatgaacagtggagtggggcatgcgaagttgacagtcacactgaaagctcctgcctcgcctctctaccttcttctcttttgggggtttctttcctgaggcagggaaaaagaaacaggaacccagaccaaactgaggaaaacacgatcagagatgagatggggtcagaggcaaagggctgtttgttgggtttgcactttcattactgagagcattggaatagttttaaggcgtgcaaactgtgagactagacaatttcacttagaaaatgaaacgtgcatgcagatgttattctcatggggatatatatctgcatctgtttgtctacaagtgttcccttgcagagtcacagacatatacaaaacctgggttccatcagctttgtctgcacatacgtggctaaatgtgtacagggatgtacaattaaagattttaaacacttgattttgacagtatattttgcagctgctgtgccaagaaccctaagctactgtgggttaattggagttgtagcaagtatttctttctcggctgtctcttttagcagagcttctctctctctctctctctctctctctctctctctctcttcccctctctccctgtttcacccctccctgcctgcctgcctctgcccctccctccctccctccctctctctctctgagatagcagacaccagagtgaaactggtgcagcttcctttgagaagcgtgcttgcatgtgcggattggcaggattgtgtgagctcctctcccatccatgcactgttcttggagggaaatgcaatgttggagcaggggctgagctgcactgggaaggtggctgggagctcagtgaggccaggatcatggtttagccaaaggctggaatcacaagaatgtttcaccagggtctgctctgagagttctcagacccccatggattttagaattttccagcctttcctccttcaccttcgcacaattttactttctcctgagatggccccagatctgcaagagacatttgagagaagctatttattagcagacgtgaagaaatggattctgcacttgattatttagccatgacttatcaatgatgatggattggaaagcagtgtaagtaacgcagttatatatgttgctggagttaggtggtctgttttcttgctattttttttttactttaactttttcagtttccttttgagaaaagtaaaaataaaatgcataaaccatttcaaagaagttaggagggtccaggttgtgcaagctttcttcttgttcaatggacttgcagaatacctagttctatcagaagagacacacaaactaccgacatagaagctacaaacatcctccggaggatgggaatgaaatgggtaataaatgaagaaggtttctgaactgacagtcattgctataatcaggcttattcagagttgctaaaatatttgacattggctcatattagaatcaaagaactaaaatgtattctctttacaggatcataaaaatgaagttagcctgtggctttcagagcaggttctttctggctgcgtaaatgtgagggtttttgtttgtttgtttgtttgtttggttttgttttttaactaatgtcaaatgttgactatgtttcctgtccatttcaacttttcttgaggtcggacatctccctattctagagtacaatgtctggtcactcttgggttgcaggccactgtctagtggaaagctagtcattgctagtttataccagtcagagacttttccatctttctgtgtgagggcttcgtttaagcacttcaattcctaagtattcagggaggaaaaacaagtcacttgaagaccaaaatcagtttatttcacaagagaaaggaacggctatttaaaagatgaaaaattgaaatttaaaaatatgatctgccttttcttcaaaatctgaagtgaggttaattttgtgtaggaagagtaacataagctttcttgattaaaaagcagtatttagaggaggcttttaagatcataaatcacttaggtaaggtcatcaaaagagatggctgatattttttatggtcatttgcaactttttaaaaaaagtccatacggtaatgttaatgcagctatttctggcttcttaaaacttgcatagatttggaagtgggatttctaacaataagagtcgtgagtttttctgagctatcattgcctttctctgtctatcacattcatacctcaggcagagctactgtccctcccacctgtccaccctgcctgtttcccagcccccatccttctctctgagtcttggaacatcatgaaagactcttctgcagatttccttttaacataccctgcccagccttggacagagggagtactgtgaagcaacatgcagggctgccaattttggaaatgaatgagcttagttgattcctgaatattaaatcagttctgtgagcagtagaatgagatcatatcttacaaacctgacccaaagtgttcctaacaactttattaattggggtttaacatcatcaagggctgtagcactgggcacccgaggggatcagcctaaacccaaatgaaatccccaaactccactcggattcctgctggccaaatgcacctagggccacgccttctaaaatatgtcctttgttatcaagggaaatctgagacagaaaacacatgttggcagcatcatgtgagcgcctctctgcacataaagtggttgtatcacaaggggaaagctttcgatcttgtgccgttttgttttggtttcttgtttatgtggactctgttagactcctgcatctggaagaggcttgaagcagagtggaaaacctagagcaaaaatcatgccggggaaaggaaaatcattaaaaaacaatgactaaaaacagaataattttcttacccaaattccagttctcatccttgttttgggttccctgttaaagcagataccagttatagccttcctgggttaggggagacagacagtctttcatcatgcccctggattttgagcaaaggagaaagcttgctccagaaatagaaaagaaaaggcaaaaagaaaccatctttcgagtttctgctcactaacagaggaagcaaccccaccctcctccacaccctcctccacccccacagcttgtgcctctcaactgcccctggtggacagctccaacctgcacccccccccaaccccgccgccccctctagaatctcacgtgttttcgtggaggaccgagagtgctttttagcagtgaatgagcaaagagaccagatatgctgatacctgcacatggtctttgagagaggcagctgattgacatcgggaaaactgctgagcaattaaaaaaaaatactagagtcaaggtgaaagaaaggagagaaagagacagcgagagagacaggtgggttgtctctaaagtttcaagcaaagttctgtgaagcacctagcaggtcaaaactgataagggcagatggtgaagaaaagtcttaaactgatcagtgccttacacatggaacgaagctttcatttcggcccgatgttctgccagaaagctttgcttgagatccaccgccagtgttcttgctttgctcaacgatcccactatgctggtatgttctctctctggacagccgtctttctaacaacgggtgctgttctgaaaagctgggagcccaagaaatgttgtaaaaaccaagcgtggccttcagctgttggaccctgaggaacagcacctgcattagggccttgctcacgtttcttactagacaggttgccagctctcatttttgccctttgtctgagctaattggccttagtgttacatcggcccacatttttctccctgtaaactccattcctccctcatttcatctacactgcagagaactctcaagctcctggtgagttttgctgcaaagcctgtggcacgctgaaagaatgcaccccttccgaacctcatcttcccacttcttccactggagacactgcgggggagaaacatgtaaatatcgttaataacaatgcatcgcgtccttgaaaattgctgctaagagagtagattgtaagtgttctcaccataaaaaagtatgtaagataatacatatgttaattagctcagtctagctattccacaatgtgtacatattttaaaacaatgtgttgtacatgataaatatatacaacttccacttgtcagttaaaaaataaaaaataagtccaggcgcagtggctcacacctgtaatcccagcactttgggagtccgaggcgggcggatcacttgaggtcaggagttcaagactggcctagccaacatggcaaaaccccgtctctactaaaaatacaaaaatgttagccaggcatggtggcgggcgtctgtagtcccagctactcaggaggctgaggcaggagaatcgcttgaacccagaaggaagaagttgcagtgagccaagatcctccactgcattccagcctgggcgacagagtaagtgagactccatctcaaaaataataataataataataaaataaaaaatagacatttatataatgaaggtttttaaaaaagaaaattaaaataaatttggagaatgacctgtgaaaaatgcctctgcaagttttcctgaccagaggaaggacttggcttctctcctagacattttttctcgtatcttcctctaggagtcagtggaagagtggcgattaggtaacatctgaatgtagtagaacccagagctgttacctccatttgagctactgctggtcattgcttgacttctattctctccatcagtaaaatgcacgcgaagcttacctcattaggtttttcgagaattaaatgagataatgcatggtgcttagcttagcgtctggccatagccttgatgtcaatactgtcctcatgttctcctgtcagcggtaggtctgtctctcagacactttccaacagaggacccagatccttaatgacaggggacctgggaagacagggaggcaatgtcacagaatggaaagcgtgctcgagtagaagtcaagacctgggtgtttgagtcccagctctgtgcataaccatttgagtgatcttaagaaaatgatcaccccctcttccatgctacagccctagatgggttactccttactccaccactctcctcaccttgactcgtgccggtccctcagcacgacgggtcctcctcctggctggctcctttcttctctccttctatgagactcccctgatcccctgagcccgagggtcagggcttctcctctgccatcctatggcacctacatctctccacgcttaccgtgcagccatcactgtctgcctttcccactcgactgtcatctctgtcttaaagctctgccttcggtgtcaagaccgggcagcactcaatgaatgtttcccgaacggatacgtaaatgacagaaggaatggatgaagagtccctgccctgcctcaggtcttgagtgaagatgaaatgaaataatgtgtgtggaaggcttggatgagtagagtgctgtgcagttgccttcagttttaagttagtatgaggacaaagcattttttataccaatattttagttggtttctcagatactgagattcacacattttagtgaaacaaaacaatattctcttttataccatccttgcagtgtgggcccattatttgttgtagaagcaggccaggctttatgtgggctagaacctctgatggttgaaactgtgagcaacaaaacttttcattgcagaatgacaggtaagattctgaaagccagtggcatgggagggctcgctctgtaactcggcttgtcccagggtatgaatgagggagttcagatccctgcctgtgagggtggagaagggaaaatggtttctaaaagcagaggaggaaagagaaagaatcatcatggaggcagcatggtcagggaaggggcagagggtgttgcatctgacaaagctgggtttggacgatagcctcatacttgggtttctgttgtatctcatgagtcctctccctggaggagtatttggattctattctgcttctcccctgagtttgttttcacggtgggactatccaggactaaagagaatggcaccgtattgctctctctttctgaacccggacttgcaggccatatctggatttatcctttttatcagcagaatggtacatttcccatagcaatgcttgaactctggtccgtgatgaagcaagctcttccatggtgttagagtctgtttttccttcagaaaatgctatttgcagaacggcaacaacaaaacgtgtaacaggaattgtccgttcccatggccagtcctcatgtagagccacaagatggcgcagaggatgacatgaaatcatgtacgcgagcgtgatttgctactaggcagctctgtagggctgtatgtattgatatcacatgcgtctatatgaacgccccgctgcagctgcctttgctatacagtgaatacactgtgggtctattattcgcctcttcagatccagcccaggagttggtgcagactcatttttcactttcctttgaccctgggtgtctccacaaatgaaccacctgctgtgtcttggtgggggtggagatgtggggtgaagtaatgagcccgcaaggcctgtctgtgcctattggctgctctaaagggaagttgaggaatactgcaaagccacaaatctgagatgtcagctcataaatctgtaagctccttgcttaagtaatacgctccttgacggccaaaactgtcatttgcacattctcttcagctgaacacaaaagttccggttaccagactgtccctggatactggggactaaaagctggtgattggcggagtttgggggtggggagggggcgctgggctgattgccctggctgctccccacagctccacggctgctgctttcacccccacctgaccatggtcgcagtggggggctttctcttggtatttaattagtaagtgtaggcaaacatttgcattgtggcactgggataggaaaagagttgaacatgaatataaaaatggggatggggccgggtgtggtggctcacacctttaatcccagccgccaaggcgggcagatcacttgaggtcaggagttcgagaccagcctggtcaacatggcgaaaaccctacctctactaaaatacaaaaacattagccgggcgtggtgacacgtgccccagctagaggcagggaggctgaggcaggagaatcacttgaacccagaaggcggaggttgcagtgagccaagattacagcactgcactctagcctgggtgagagagtgagactctgtctcaaaaaaaaaaaaaaggaaatgggagaaatagtttccagcatttagcttttggcgacaatgactaaatcaatacaaatgttaatctctgttgcattatgcttttgaaactgtattggcagtttaggaaaaatccagtcaacagtttaatatgaaaatagagacctgtagaccaaatggagggcaggaagcagatatttgccacacaaacatttattgagcgcttgatgtattataggtgctgtgtaaagttttggagattcagaaatgaatcaaagagaggagtgaacatacaaattatcccaactataataccggtgataagccacaaggtagctctgctagcacggaacatatggaagagatgaataattctgcttcggagggaaggagtcatattagagttgggtctagaagaatgagcaggaggtggctgggaagggagggcgtttgggcagaggaattggcatgattctctgtgtatgcacaggaccatgaaagtgaatggtgtcatgtaatttttttttttttttttttttgagaatgagtctcactctatcgcgcaggccggagtgcagtggcacgatctcggctcactgcaacctccacctcctgggttcaagcaatcctctgcctcagtctcccaagtagctgggattacagacgcctgccacaacaatcggctaatttttgtatttttagtagagacgagggttcaccatcttggccaggctggtcttgaactcctgaccttgtgatccacctgcctcagcctcccaaaatgctgagattacaggcgtgagccaccgcacccagcaggtgtcatgtaattttattcatatttcctgatgactaagacaacgtatttttcagattctcaaaacaggcaatgattagtaatagatcaccttaaataggatgttataatggtgatgaagaccaatcacagctgcctggaaacagtagatcatgggtcaataatgggcccacacctgggttttgttactgagtcaacctacgctacttgttcatgttgtacctatttatcttgagctggtattagtatatccatttctaaaaatccttgcttgagaaggaaaaactattcaggagaaagaagaggagataaagtctaaacaacttgatttcacttgaaaagtcctaagtcgtcccttggaaactatctatagtaaaaagcatgggattttataccgtgttttaggcaactgaaaggcttttttacaattgtagtaaacactgactgccagcattctggtaccagttactttattaaggtaaattcccaaaactcacaatagtgggaaaaaatactgataagccttctaaaacaccaaagaagtgtagaacaacatcttggatgcttttagtcacgagtcagaacgccgcggtggttacagagcaatagcatttcagagctgggagagaccttagagatcatgtattttgtggattttcaaatctttgaagaatgatgttctgggtaaggaagctgctaagagtccatgagctagttagtgaggactgctacactcttacacactcactcccggatccctttgtgcatgatttctgtcattcaaccagtgttcataaagcccttgtaacatggaggataaatatttgaataagatactggctttaccccgcagaagcttagagctttgaaaggaggtaagacatataggtaaataatacacataggaagttattttaaaaatataatgagagttattagagttcagaagatggaaacttatttcctagtgaaatggatgactgtgtcctgtaatagaatatttactatatttagtaacagatttatacagtctcatttgttttagttaagaagtttgagtatccaacagagaaaaaaggttaggtaaaaattaagtacagtgaggccaggcacagtggctcacacctgtaatctcagcactttgggaggctgaggcaggcggatcacttgaggttagaagttcaagaccagcctggccaacatggtgaaaccccatctctactaaaaatacaaaaattagccaggtgtgatggtgggtgcctgtaattccagctattctggaggctgaggcaagagaattgctttaactcaggaggcagaggctgcagtgagtcgaggtggtaccactgcactccagcctgggtgacagagtagaaccccatctcaaaaaaaaaaaagaaaagaaaaaattaagtatagtcatgtgtcactgaatgatggggatgtgttctgagaaatgaatcattaggtgattttgttgttgtttgaacatcatggagtgtacttccacaaatctagatggtatagcctcctacacacctaggctagagggtaggactgttgctgtactgaatagtgtagccatttgtaacacaatggtaagtatttgtgtccctaaacatatctaaacacagaaaaggtacagtaaaaataagattatcttatgggaccaccagtatatatgtggttcgtccttgactgaaacgttatacggtgcatgactgtatttggtttagcccatgtttttattttgaagaaatgcagaacaagtttaaaattgaattgttgaattgttgtcattagttgatagcctaataagaacatattgttcaagtacaagaatatcattgatttaattaccctgaaaatataattttgaaaaatatctacattttttaaaaattaaattttcgtagtgtaaactaaaattaaatactcaactaactgagagagagagagagagagagagagagagagagcccttccccagctagtctggcagcaagtgatttctaaaggccagaaataggaaaaaaaaaataatcgaatcaaattgacttttggaattgtccttatgaagcacaagtctacaacctttaactcatagagaacacagtgagcatatctgctttgactggcaacttcaaaaaacccctctcccagaggcttgggaaaacacatgttggacacagactaatgataatgtggaacaattattacaatgaacacaataattgtatttgttttatgaacatgatagcctgaagaaacccataccaagaaatattttacgtgttgtcatcattaagaagtcagcaaaccttaaagacaaacacaatctattcatccatccatccatccatccatccatccacccattcatccatccatccacccattcatccatccatccatccatccatccatccatccacccacccacccatccatccatccatccatccatccatccatccatccatccatccatccattctgtaagtgtttattgagtatccactgcatagcatgcaccattcctggcagttaagaaaataaaaggcctcactctcatggaacttacatcagaaagggcaatattaatgatcagccctgaccacatgcctttccctattaatgatcagcccggaccacatgcctttcccttagggaacattgtaggatgaatgttccctgtggtctgaatgtttgtgtctccctctaaattcataagctgaaatcctaacccataagatgatgtcattgtaacattgtagggtgtattttagttggtgtggatatggaggcagaaaagcaaggatactggtgaacctggggaatgcttaagaggttggactgtgctgtacccgttaaaaagcaataaacaggctgggcgtggtggctcacgcctgtaatcccagcattttgggaggccgaggcgggcggatcacgaggtcaggagatcaagaccatcctggctaacacggtgaaaccccgtctttactaaaaatacaaaaaattagccaggtgtggtggcgagcacctgtagtcccagctactccgaaggctgaggcaggagaatggcgtgaacccgggaggcggagcttgcagtgagccgagatcgcaccactgcactccatccagcctgagtgacagagcgagactccgtcttaaaaaaaaaaaaaaagcaataaacagaatctcatgcttctatacaataaaaataaccatcttccctatagatgatgaagagtctgttaatataatctgacaggcttgttttggaaaatatttagatacttatacatccagatatattccaaaccatagccttgtaaaacctctgagctagcgcaatccttgagtataagtctacctccacctagaccaatgtttccaaaccattctgtggctgggaagactggaaggacccccaggctgaccctgttgggaagacatgcaacaaggcttacttcttcagtggtgtcagtgattttgagccagttctgaccatccactcatccgtctgtatttgtgtagtgctcactatagacaaggcaattttggggaatgcagttgtaggaaagatagacatggctcctgaccttatgaaatgttcagtcttgtgaggaagacacaaataattacagcccattgtaagaagcggtaaggtgcttttgtacccttttggtccatttttctttttttttgttttgagatggagtcttgctctgtcacccaggctggatggagtgcagtggtgcgatctcggctcactgcaagctctgcctcccgtgttcacgccattctcctgcctcagcctcccaagtagctgggactacaggcacccgccaccatgcccggctaattttttgtatttttagtagagacggggtttcaccgtgttagccaggatggtctcgatctcctgacctcatgatctgcccgccttggcctcccaaagtgctgggattacaggtgtgagccaccgcgcccggcctggtccatttttcatcttgaccatggaccacgctggtagatgcctgggggcatgagggacatagcaatcaggctctgtcagcctttgtgaccagcacaacttatttccagtgcattaaagaaaatgatactgcctatgcccaatttagatgtgggccagctgtgttagttagcttaacacagcattttgttttgcatatgtattgattttgcgcacatgctctctaagtgcctcagaacactgcctacagcatcctggtgaggttgacaatcagttgtcctgtccctgttcatctggcatggggacacactgtcagaggaggaactaccaagtaagtaattgcctccagcacacaaaaactgcagacacatggttgacataagaatctagtttcagctggtggttttcagggcaaagcaactgcactaacaggagatttccctgacagctgatttaaggctgtggaagaccccagtttatcagctcaaattgagaatgtccttttttgactagaaacgagaccctcccagccaactgcacaaccaaaacttatattcaggatgtccaggacctgaaactgacatgggagtcaatattctacagccagttgtggtgtcgacagggtctgggggaaatcttcagagctgacttgtgatgtagcagggcttacagcaaaggcatccctttcaccttgctctttaggattcatattctaagaagctgctaagaaaaaatgtctaaacggagacacttaggatatagttttcatattaatgttttattttaacaataatgggagcaaacacctaccaggtgtttactctgcgtcaggaactgttctgataatcttatttgaactttgcaacaattccatgaggctagctactcttaccatcctgttttacagctggggaaactgtggcacaggaaagttaaggaacttgaccatggccacagagctctgagtgtcagaaagaagatttgaaaccacacagttggcttcgcatcctgtacgcttgactatttctcttttctgcctctcttgggagaactctgaaatactaaagtactatattactaaataaatgcttgctaaagcatttatttggtcccatattctcaatttacacaattcttttctccaatcacatttcattttagactttatgagccctgttgaagtcatcagcttaaaagtgcccttgagcaattctctactctagattgagttaaacagagtatctgtagataatctagaatcacagacaatacctgtcttagttcctttgggtcgttataacaaaaataccatagtctaaatttataaacaacggaagtttattttgtacagttctagaggccgagaagttaaagatcaagagaccatcaggttcagtgtctggtaagggcccactctggttcacagatggtgccttctcgctgtgtcttcacatggcagaaggggcaaacaagctccctgggctccttttttaagggcactaatcccattcaccagggctccaccctcatgacctaatcaccttctaaatgccccatctccaaataccatcatcttgtgggttaggatttcaacttatgaatttaaagagggacataaacattcagaccacagcaacatctaattttgagccacctaactttgaaagaacaaggattgattaatccaatgtcagcatacagtataccattagatgtgagcccctcttggcaaacttgataaaagtgtgagaaaaaaattacctagaagactaataaatacagaatagtcacatataatttctgtttaaagatttataccttaccaatttccccaaaatgatttaacacaactcattaaatatttgtaaaataatttaaatcttaaaatatatattgggaaccagttaggaggagagagaaaaagacaccggttcctagaccagcttggttattgtacttggacatttcttaggctctgaattttatggacgctaaggcaaatggatcacaaaggagtaaaagataggggaagggaacaaaagcatttagtgtgctcccactgtgtgcagatcattctgttggccactttcccataccttacgccctttattctcacaacagacccttgaggtagttaccgttattttcatccacatcaaagtatgtggcagaggcaggatttgaaccaagcctatttgactccaaagcctgtatgtatttttttactaggtttaggttttattattcttacccaataaagtgacatatgatttgtctggagatacctagtcttcctttgaggattttttaaaaaatggatccctatgtagagaacattgggtaaaatcatagtaacctatgaaaagtaggtattcaatcaatgtttatggaataacatgagtaaataaatgcatggataataagatgaaggatatcttctttaattttataagctaagtaactgttttttgtaaatgcttctatgttaactattaacctctataaaaaacaaagccatatcttagcttcataattcagtctaaggcagttaggtaaatacttaacaatttaatattttatgtttttttctttcatagtttaatttctcaaaagaatagccgaggccccccttatctttacttcttccacccctatttacttctcaacccactgaaatgtgctccgtgtttcctctgattctgttcaaggtcaataatgaactcattaattctaatccaagggacactttgcattctctgtcttttttggtctctcaggggcatttaacattcttagccacttgttccgtcttcctctttacctctctggctgctcctttgtaatcttctcttttatattcactcatgaagtattgaggattttcatggatctgtcacgggttgtgttctgcttgccttctactctgcacctccctgggtcatctcatccactctcataactccagctgccagcttcatgcagaagactctcaaatctgaaaactgggatcaactattttttatatccaaatactctaaatgaagatctaagccaagactgtctatcttgaaagtaagttatttctgtctatggaggcaaaggctcacgtaggaagtgaagaatcttatatatttctaagccatttcttggcagtcagtcacgtattaggagtcagttctgtgtgtttttaaatacagcattgaacgactcagtgtttgttgttattagtgatttgttggacaggatagagagaaagcacagttatttaaagataaagtgtttgtagcccttctcaattgaatagcatacatacagataagatgtctgtgaaattttaatagaaatcaatgtgaaataagattcaatttataaaatctcaaattacaggcaacttgtcaaagcctagctgttgtgtaaacgtgggaattcacacaaggaaaagatgattgattggttgattgattatataacatgagttacattctatccaattgcacctgaatatattcacagacgcagctggatggctctgatttagagaacaagtattttcttcttttcacacaatctgttcctagaagcgccatcaaaacataaatattattttctcataataatataaggcatagtgattttattcttagccaaggatttagtgttgtagaattagttataattaacaatgtgttagtaaagttgagatagtattttaaacctatctgagtacttaaaataatgtaattttgctccagattctgccaaaaaaaatggaaattatttaacctaggattctaataactaacagtatccatagcattaaaaattacctttacatattgtaaatgtcacctgcctacaaataacatgtccattaaagtaaacattacttaaatatgcagctcaacagggcctggtttctttacaattaactagaaaatttgaactaaatcttcctgaagatttcttctctattaaaaacaaaagctgcctcctttccttgcttcacagctttttggacctgcctgtgatgagtgtcctttattgcccagtgtaattttgccatggtttttagcaatctgcaaacactccagcccaggtaacctgacggtagcatagacaggaaaggaggggatgtgaatttctgcctctctgcctctagtggggctgctaaggtaccagccatctaaacatctgcccaggtcttggtgcagtccagcttttcagcagagtcaagggcagaaattctgcccgacttctgtgtctggtacctatttgtacaatgcagaggtcccatgcaaattgttttcctttgaaataaccttaatgatttcttcaggtttcaactacagtaaataatttgttaaataaaaatattagaatgaaaggggggaaaagaaattacttcctctagcaaatgagactcttaaattcaaatttaattaaccaagacgcccccaaaccacagagcatgtcacccagcgttgacaattaattagctttgctctgaaagagctacaggtacccagcaaagagttacggattaaaggctttactcgctctgcgaaggctgcccatttctagctatcacaccttgatagtggtttgttgcttcaggcaacaaattacatctgaagtgtgtgatttcatgtccgtttttaatttcacacaattgaaatatgggaaaagtgaaaataaagctctacttcttttcaaaataaagctctatttctttcaaaataaagacattaaaagtgaacaacactacttcttttcggtttctcatgctgttcaagataattttctatcaaacggtgaaggaagataaatactaaggaaaactctaaaggaatgagtggtcactcttggcttttaggcgggctctctgtttatggtagaccattcagcttcttccttttagcattaaattagcatatgtataaatgatttaactagaaacttggagctagcatctaaaaggcagcatggtgtaatgaaaagaacattagattccttcgattcttgaaatcagattatctgggatatgcttatcccttgaaggaatcttaattttagttggatagtccttaaactagaaaagatatacgtacatattttatagacaattgcttctcagccgaaaaatcaggcactgacattccatgaggaatggactttaattagccggtgattgtctttctctgtctatatttataggcaaccgaaatagctgggttgtaggtacatggtttcatcaattccatttaataagaccagccagttcactatcattcatgttcatgaaagataggaataacgtcagttaactaaaatcatttatatctggctttgggatggctttttttttttttttttttttttttttgagatggagtctggctatgtcgcccaggctggagcgcagtggcgtgatctcggctcactgcaagctccacctcccgggttcatgccattctcctgcctcagcctcccgagtagctgggactacaggcgcctgcaaccacgcccggctaattttttgtatttttagtagagacggggtttcaccgcattagccaggatggtctcgatctcctgacctcgtgatccacctgcctcggcctccgaaagtgatgggattacagacgtgagccaccgcgcccggcccgggatggctttttaatgcatgtttaaatggatctggtgtcttaggtgtttacagttcttttaatttatgtattaagcccagtttccataattgcatactaggtggaacttaggaaaaggcaagaagctattaagtttccctggtactaagcaggcctgggggtgggcagatcaggccaggaacataaagacctgcagtcagggagcatccgataagaacggattgatggtcaaaaggtcagctggcacagggaaaagtacgtgtgcacctaagtgcagatgaaaaagaaagatccacccacactggcgccgaggcttgcaagtggatgtctggcaagcaagcagaagccgagatgcagatcaggaagctaaaataaagaagctggggcatctgggaagaccgagacccagggctccgcacaggctaaacagcaggaagaagagcgagtagaattggggtataggcgtggccaggtcatcagttacccaggtgcacggcggctgtcaggaggtcaggcagcaggcaaaactctgttcacaggtaggatagtgtgagggatcctgcccgctgtgctttctcaagtagggactttttacctctcattgtccaacgtacttctgcttttctcctccctgatgaagatcttgtgactgtgtactggcaggttggagcccacccctccaggacagcagggagcaaaggaagggtagctttgtaggtgtgggtggagataaatattcatgcatgggcaatgaagcagctctaagctatggaatcacatgtcaacccatatgtcacgtggcatcaaaggcagtttatacattggtaaaatgttcctttgaacttttctattccacaggaattgggaataagttttgggttatttcatcttccagtgtccttaaaaatgtggagcatgctctctcttaaaaatatgaatggttgctgtggcttagagcaagtcgccaccttcccgaggtcatccaactctcagaaacagaacttctctgttttaatgagtgtttttctctagatcttgacctagaacttgttgtctaggcagtatctgggtctgacttactaggtttgctggacagacagaaatagaaaagtgcaatgagacaatcgatatgttcttaggtgcccacagagtgtggcaccaacttgtcaagttctggacaaaattagattcattagtgcagaagtcctcaaccttctcttgggtcctgaagcccagcttttgcagatggcgtcttagtcattagtaaggccgctccatcggagtccccgtcatacaaaatattaaaggaagctgtgaagatcggttgcagtgtctgctatcctgctgtcgtctggccagaggtgagccgagactgtggggcagcggggtactgagcagctgctgtataatgagccgagaggggttaacccctggcaaggcaagcagaagagtcattcttaacatgcttagaatcccaatattcattgcagcagcttcaccaaccctgaaaaaccacagcatcagatggtttcttagtaaatacacttatcagaaacagaggcagagggtgcttccctttgaacttctgagacaaaagcccccagcaaggcatggattctgccaccgacggagtatttatttggtctttctaaaatccagatctctgcagccaggaaataacaaactcttgctttgtacttctgtttagccttccatgccaatgactatttttttaattaaatattttctgctttatttttgtgtacaaaagtgtctattttcacacagggaacttggctcagcaaacattcgtagttacttggctttaaacaaaggagaaggttttacattgaatagcttttatttaaaaattggtttatactatcgaaaggaaacattgaggaaaccccccagggcatttggactgggcacagatttcttgaggaacaccccacaagcacaggtaaccaaagcaaaaacggacaaatgggatcacatcaggttaaaaagctgccgcacagcacaggaaacaatcaacaaggtgaagagacaacccacagaatgggagaaaatatttgcaaactatccatctgacaagggattaatacccagaatatataaggagctcaaacaactctatggaaaaaaaaatctaataatccaatttaaaaatgggcaaaagatctgaatagacatttctcgaaagaagacatacaagtggcagacaggtacatgaaaaggtgctcaacatcattcattgatcatcatagaaatgcaaatcaaaactacaatgagattatcatctcaccacagttaaaatggcttttatccaaaaatcaggcaataacaaatgctggtgaggatgtggagaaaagggaaccctcatacactgtggatgggaatgtaaattagtacaaccactgtagagaacagtttggagcttcctcaaaaaactaacaattgaactaccacgcaatctagcaatggtagtactgggtatttatccaaaggataggaggtcagtatatcaaagagatagccaagctcccatgtttattgcagcactattcacaatagtcaagagttggaagcaatctaagcatccatcaatagacaaatgaataaagaaaaggtggtacatatacagaatggagtactcttcagccataaagaagaatgagatcctgccatttgcaacaacatggatggaactggaggtcattatgttaagtgaaattagcgaggcccagaaaaacagacttcacatgtttttatgtgtgctgcccagatgacacaattcaggaaaatctttcagctcctaccagagagtaaagctcttcagctgtagtgggtttacctgctgtgtgtcttcaggcttctcccagttctttatctctgctgtggagccaatataaagttatcaataacatttggtggtgtagatgcttctcatctgtgcaatttaggagtagactctaatacagagcagctgctgggtgaaccaaagatggctttagtgatatttatagcttattgattgcatagttctttgtctgtgattatcattcaataaatactgatggactgagtttcccggaacactgagattcgttttaagcagcttccagcattctttctgtgtatgtggggggaggttcaggaggcagtagaaggtggccataataatgttgtcttgtggtggtagtagttgttataatttcccttttatatcctaattctggccacgacctaactcactgtactgagacattttccccctataatatggagatatgttgctaagcaaccagatcagtaattggtaagtgcttatgtataatatgatttgatttgagttacatacaaaaatatgtaaatggttttttatcttcattattagataaatgattatcatttggttttattttgcccaaataaaataactgctttcatttaccaaaattaacatgatgtagtagaaaggccttggatttagaggatggaaacacgaatgcaagtcccaggtctgagagtcagcagccctgtggccatggctaaagtcagggaacttgccaggcctcgttcttttttttcaacccgtaatgtgtggtacaaataccttctctgctggcctcccagggccaggttaaggatggatgtgatgatgtatagaaaatgttttaagaaaaaaaaaatccaaggtctaagcattgtctagaattccaggctacttaatcttggaactctgagtctgttagtataattccaaaggctggattgactaagaagtactgtcctccagcagggcacagagccatagggcaggtctgcgcctatagaagaaagtaaacacatggcatggaccctgaataagtgaacagtgcagtgatggtggcgaggcagaagcaaaaggccacatggtcaagcaccctgtcattaagcattaaaacataagatagatcatctcaagaccaactgctggccaggtgcagtggctcacacctgttattcctgcactttgggaggctgagatgagaggatcactcgaggcgaggagttcaagaccatcctgggcaacaaagtgagtccctgtctctacacaaaaaacctttttcaattagccaggcatgatggggcacacctgtagtcctcgctactctctaggatcacttcagcccagaagtttgaggctgcagtgggctatgatcatgccacagcactccagcatggtgacagagccagaccctgtccttaagaaaaaaacaaagcaaacaacaaaaagacaactgctataagacttcaaggggaaggacaatgatccacgggggctgaagtcactgatgagggcaacttctacaagtccttgaagcataggaaaattcttttttcttttcttttcttttcttttcttttctttttttttttttttgagacagagtcttgctctgtcgcccaggctggagtgcagtggcgcgatctcggctcactgcaagctctgcctcccgggttcacgccattctcctgcctcagcctcccgagtagctgggactacaggcgcccgccaccatgcccagctaattttttgtatttttggtagagacggggtttcatcgtgttagccaggatggtctcgatctcccgacctcgtgatccgcctgcctcggcctcccaaagtgctgggattacaggcgtgaggggaaatttttaagggtaaattcacagcgatgatttccattggttaactctgtgcattaacatgcaaatgtcaatccatttccaaatgataacagtgcctggctgtagtattttaacatgatattgtttgaggctaatggccaccatgtttgcctcctagcagtaaacatgttatttgaagtcatgtcatgaattaccttcctgcactaatgaaatagataatttacataaaaatcaggaaaaaaaaaaccccagccccatatgcttttcaatctctagagccatggaaatgacctccctgacagccaattagaaaatacaaaggtgaaggtggatgctcttattcccgatacggagaagttccagaatgactagcgtgcttcttggctatgcccaaatacttttaagtaggtgttatttcataataaagcattaatggtgtttgttacatgtggatgaatatcttcactgtgtctgggagctctgcctcagaacgtaggatcttgttccctatccctgctgtttataatctgttttattaccttctcccactgtgtcatggaccggatggtttttctaggggctgctgtgatctgtcttgtcattgcttattatcagatagccttaatcctcagaacattgaaatagttctataatggcacgtgagccatggcagcccacagcagcactggccattttcacatgaaatggcagcctggattgtcctttacatgctgacaggggagactgtccatctgccacccctgtcctgggtcgggaccctttctgttcagcaggtgcagtggctctgagagtctcacagtttttcagttgatatctcacccatcaattacctgggttggatttgtagagctcgaatgacctcttaaattttataaacactttacccacctatttgagcatcccacacttgagcacccctcagacaagatgaaatattcttaggatagggttaggaacacacagtattcctgaaacttttaaagatatagaggtccttaaaaattaccatattgcctgattttcctgtctgtgccccaaggaaagttctattcttcatgaagctaataatttttaaaagattgctaggtcaatattttagtaatctttagacactaaggataggagatttcaatttaattctcatgagatgcacttagaatgacgggttttccatttgaacaccctgcagttctcacaatccagggtaatagtctgacaaatagtctattatacaattacaaaaaaaaaaaagtcaaaatcaagttccccctctaatctacataattgagacctaagactttccctgcacttaaagccattgaatccaccagatgagtgtggacctcatttttttaggtttgggtagatctggccaatgagagcaagtaaccatcctatgtgaagttcatttcagttctaaactgatccttgaattcagatattgtcatattgatgcattaggagaattgtcttgggtgtgagatgagtgaggctatggagagaaaggactggcactcagagggaagactgagcttactgggacattctagccaaggacaggctactgctcttctcctcactgcctgataatgctcagtgtggcaccactttttttttttttatttctgagacagagtctcgtgctgtcccccaggctggtgtgcagtggcgtgatcttggctcactgcaacctctgcctcccaggttcaagcaattctcctgcctcaacctcctaaatagctaggattacaggtgtgcgccaccatgcccagctaatttttgtattttcaatagagatggggtttcaccatgttagccaggctggtcttgaactcctgacctcgtgatctgcctgcctcggcctcccagagtgctgggattacaggtgtgagccatcgcacctggcccactttttgtttttttataggtgttcaggaaatattaatttcatcctgctagagagactttttccttgaaataaggcacagataattatatgaagctaatggatgtttaaagatgtatgctgggataaatagctttaggaaatatattgtactatccttggtaagaataagacaagtagtttttaagttatggtagtttttaagttaatttttctgctactggaaatcttataaaacaacccattcattttttcctatgaaagaaagaacttatcaggcattaattacataaaatatacttctaatcaaaatgtctttaccttttcttttttttttttttgagatggagtgttgctctgtcacccaggctggagtgcagcagcacgatctcggctcactgcaacctctacctcccaggttcaagcgattctcccacctcagccacccgagtagctggcattacaggcatgtgccaccatgctcgactagtttttggattttagctgagatgggggtctcaccatgttggtcaggctggtctcgatctcctgaccttaagtgatccacccacctcggcctcccaaagtgctgggattacaggcgtgagccactgcacctggccgtctttaccttttcaattctctcatgactgcctctcctttatgtccctaaataatacaattatacgtgaatgatttctcaaccttaaccttctcttctctgtgtcattgaagtgctatatgaaaagaactgaagctgctgacctctaagacattggaatatataaaaaaagatcaaacagctgcttataatgatgtcaaagataaaatgctattatagaatctatggctgtaaaaatgtgatttatattaatttttagtattctgaaaatttcctgatatatttattttatacacacattttaagaaaataattttatatgcattctcaagatgacttcctctatcactgtttttctgcattgaagccaacggaggctttcctaaatggagtagagtccaggagtcattgcagaatctctatactggaaatcattctggttccccactgcacgcatccctctccctcgtattcctggtaagcagttttctacccaccatttggatattttcagtgacaaaacacactcactattttatgaagccaacacatcactagtgggttattccaattttgagagaaatgtcgcttatacttatcaagctaaagatgcttttatgtttcacctgctgctttggtacctgtattacataggtttaacccctattcagatacaatacggtacaatacaggacacataggcctagattcagccttggctctactacttattatttattatattctttcaaaggatcattgattagtgtactaaatgctttacatgtactgtcattaaattctcataaaaagtctaaaaaagtaggtattatttttgcttcatcttcctatgtggaaactgaggcttgataataatatttataatagtgatgatgatgatgatagcattgtcatgtgccaactgtgttccaggcactgtgcttgggcctttataaacattatcagaatttaggtaacttccctaagattatctacctagcatctaggaagctggatgttcaaactaagtcagaaaggcctcaggatttaactgccttgagcttcacttgtttgtctgttaaatgggggtaatattgttctcctcacgagggcttctgagattcaaaaaaatggcttatgaaagtatctggcatccttgcttgaaagatacttccacatgtcatttattcatttctttaaagagagctttcttgaaagactctttccttcctctttctccaggtttcttttctccaggctaaatatccccagctcctgtagtcttcgttcattcattcaaaacataccgtgagctctcttccctggtaaaatttacattctagaggggaaacagacagtaaagcaataaacatggtaaccaagtaaagcatctgctatgttacaagataataggtgtcatggttgtgaacaaccaagataatggaaattaggagtctgggagtgagtggtgttttattgactgtggctgtgtgacaaattacccccaaaacttagtggctaaaagcagcaatgatcatttatcatctctcgaggtttctgggggtctaaaattcagataagacttagtgggtgtgatttatctctgttccatgatgtctgggacctcaggcagaagacttgaaggatggcatctggaatcctctaaaggctcattccttcatatgtctggcagttgatactggctgtcttctggggtcctcagttcttttccacttgaccctctccatgtgacctgggcttcctcacagcatggaagctgcgttcccacggtgagtgtctcaagaaaggaagccagggagaggccattattgccttttgtatccaaagctcagaagctctacagcatcacttccattacattctgttggccagggcaatttcagagttttgcttgggttcaagaaggaacatagacgcccacctctcaaggggagagtatcagtgtcaggttgtaagaagtgcctgtgggagacacatggatgcagccatctttggaaaggactgtctgccatgatgggcaaggtaggttcacggataaggtaacatttgagcgaagatttaaaggagatgagggagtgagccatatgcccatctccatctcggcagagcattccaggctgactcaagagcctgtgcaaaggccctgagatggggattggaccaagaatatttggaggctaggatgactggagcagaatcatcaaagaagagagtagtaggaaaagtggtctgagggatatggggggaagggacagaccacgtaggctttataggccactgcaagtactttggcttttactctgagtgatatggagagccaaagggagggccttgagcagacttaaatcttaaaagagttactctggctcctttgtgaataggcaggtggagagcgagtacagaagatggcagacaagttaggagactgtggcagcaattcagcaagagaagtctgtggctctgaccaagatggtagtaaaggtggtgagaggtgatgggatcacagatctactttgaagttttagccaacaaaacttcctgatggattatgtgtgagaagaagacaggtcagcatcgaagaagtcattggaaggatggaattgccattttctgatacaggaaatgctgaatgtgtaacagctttgcaggaaaaacatcaggacttcagttttagggttggcaagcttgagatgtttattagatatccaagtggaattgttgaagaggtaattagatacataaataaggatttccagagagggatctaagctggaaataaaaattgattaatcataggcattaaggatgttatttaaatcatgatcctggaagaaaacaccaagggattgagtgaagcagtaaagaggacaaggactgagccctgaggcctccatcgttaagaagctgggcagaagagaaggaaccagcaaaggaaactggaaaggaatggccagggtgtcctagaaaccgagcagaaagggtatcaaggaggaaggacctactcactgctctgagaggtcaagatggggctgagaaccattaacttgagcaatcatggtggtcattgggaacccagacaagagcagtttcagatgagtcatgggacacatgcctgaatggaatgagcttatagataatggaaggagagggcctgcagaaggccagcacagacaacactttccctgagttttgcggccaagatgggcaaggaagtagaacagtagctggctggggaagaatcaggagaaggatttgtgttttatgttttaagatgagagaaataacaacatgtctatgtgctgttgggaatgatctagtagcgtgaaagtttgtaggagggagagggaggagggaaaccttggagggatatcctggggtgtgctttactttcagggatcctcgcttttctcctcagcaggggatgtgtggggtgggcctgggtggcagagataagaaaaaggaaaaagccatgaggctactgcccgttctaagctgcctttcagtatcactcccttcccctgtctgtctctccatgtggactgggaaccccagcaggtaggggagtgggaaccatagccattgcctggtcctttttacactgtgaaaaggaaccttgaatgtagatggataaacaccatcttttagttcctggcagatcactgtcttccttcttgttctagtcctctgagacataggcaggctggcttgagagcagggagggatcgctgagcagaggtgtgtgcgggtgttagaaggtgccatgatgccttgtgccaatgactgacctgggatgagtcactgttcatttagggagagaatttcaaaaggaatgactggtcattgaataattccatttcacccttgattttagaaggaaagtgccaggaagggtagcaatgagatgaaaaaaaaagtattcctaggtttttcttttcactgattgaaaagaaagtgtcccgtgccttccctttctcatcatcctacaatagggtgacttagggtatcttcccatcaaaatcagtaattcctcacatatctcttccccctgtatttcactcttgtgaaacagattttcagttttacagatgagaacaattaagctttgaaatggtaacaccatttgctatatttgtgcagtggcaattttttagctcagaatttatcaaaagcatgacacttaatgatacagaattaaaaccagctatcccagaccattgaaggagaccggggtcggggagggagaggcggtgcaaacggtgttgcttttgtctttctgacctgcttctctcgtgatgtgttctgcaactggtaagaacattggatgaattataagattttaatcagtagaataaagtcagggcggtcctttcattttaagcagcagctcaaacatttgatgaggaaattagaatccttagaataagagtttagtgtgtaaacatcaagaattcatccagaaatgagtatattagagtctgtgaaatgccttcgcctcacactgccccttcccctgttttcttcttcttttctgtgataagatgatcatggatttgttttgtttttcttttgagacggagtctcactctgtcacccagcctggagagcagtggcgctatctgggctcactgcaacctccgcctcctgggttcaagcgatcctcctgcctcagcctcccgaatagctgggattacaggcatgcaccaccacacccggctaatttttgtatttttagtagagatggggtttctccatgttggccaggctggtctcgaactcctgacctcaggtgagctgcctgcctcggcctcccaaagtgctgggattacaggtgtgagccaccgtgcctggccaagattatcatgttttaagtgttacaggacacttgaatgatggacgatgtcattggaacagcctatgttattaatgatgccggcagcctcccctcccacctttccctgccttcacactctgtgcccccttcagtgctttgaccccttactcctcgcacttgaccatgaattgcattttgtatttaaagacctccctgcacaatatcctcttatctacgtaagcagcccatagcctcagcgccctgcaccctggttggagttcaccttctgatttggtggtatatttctaaaaccagtttgatttttcctgttgcactggggcttgtgtttttcttccagtgccctgtacatagcatgccttgactggtctccacatcgttcttcatcagactggtttggattttacaaggtgttagagtttttaaattagctcatgaggtctctcgcacctgagtttatgccagagaagttgtggagtgatgaacttaatgggtgcccttatccccaaagatgcccagctttgttcctgcttaagctgaatgttggtggataacacatcattctttgtaaatcgtgattgcagaatcctgctattttatggctttgtttttccttttgtcgtataaatgattgggtagctcgttaacttcactctgttatagtaagggactgctacagaggacactgagcaggaggagagaaggaatgattaggcctcagaaagaacgaggggttgtttaagagaaaacgaagtaagcctagcagatctgatcgtacaatcattttccccttattgttcctttttccactccagagctgcccagaagttaaatctgtcttctaaaaagaagaaacatcggccttccacttcttccgctgccgaaccaccgctctttgcaaccagcttcagtgggattctgcagacctcccctcccccagccccaccctgcctgctgagggctgtcaacaaggtgaaggacaccccggggctgggcaaggtaggaccatccgccgtccctgccatttgcccagtgtgcgaggttctggatcaagtttcaggaggaagaaaatgaggcctccaatgtattaaaataagacgttgccagggagaaaaggaggcaagatgaaattcatttgaaagtcctgaaaattgtcatggttgcatacactaagtggtaaactaagaccttcagattgtaagagatctgatttgcttttggtgggaaaaatcagctttgcattgtttgacagaatcgtagccatttaaagaaaagacacaaaggcacaaaatatcgaggcaggggcaggagaccgagggaggccacagcacaaggtacagaaatgagacgtaatgaggcctcataatttccctgtgacactttcgagtttttgcctcctcttcagagaaatcctgacttctgctttgaagcagcccactgaggggattgtgaggaacgctgcagtcttgcctttctagccaacaagtgcgatttcgaattgttacaaatgctcaggaagagatgtaggatcgtgcttacaagctgttgctcagctacacttgggatcactttatttttaaatgtcatttctaaattctttctcccttccgaggaaagcgtttgggtgaagtaacttacggtttactcatcattggtgaataagccagggctcatacaaacatgtagtgaaagaaagacgtggcggtttaattttttatttttatcaaaagtaggagtggtgcacacgacctcactggtcctttacagacttatcgtgactccggccctgggcttcatttggccgccgttgctagtcttgctgaagctccggagcaactactaaactgtggggatttagattttacttgttcagttcgcagactgccagtcccctgggtacccaaacacggtcatggctgggtttctgggcctcagaaggcctctgtctctctggagtctccccttgcaccctctaccctctcttcttttcacctttcccagtttctcccgtgtccttccatgctctcccaccctcaatctcaccacctcgttgggaaggtattaacttcatgtggtacttttcccaagaagagtttaaattttaagattacatggaataggtcaggcactgtggctcacacctgtaatcccagagctttgggaggccacagcaagagaagcacttgaggctaggagttcaagaccagcctgggtaacatagcaagaccctgtctctacaaaaaatttaaaagtcagctgggcacagtggcagatgcctgtagtcccagctactcaggaggctaaggagggaggatcacttgagcccaggagttagaggctgcagtgagcaatgatcgtgccactgcactctagcctgggccacagagtgtctctattttttgaaaacttacattgaacagagcagtgcctcctctgaggggaagcatccagtcctggagctttccttggtggtgggcagggcagacagttttcagctgagggctttcccaggcccagcagcaaagtaagacccaaggaggcagggaagtggcctgggctgtctacagggcctgccccagcatcactggacatggaagcaggtggaaaaaacagtgtggaccaggactcctgtccaggagaggactcagtgggtgggagcccccgaggaggggccgtggtacgccacaggggcacacgggtgtgatcgtggatggttgattcgctgccttctaaggagggtgggtccaagtaactgctgggatcttctattcttttttacattttttatttttaattgtggtaagatacaggtaacataaaatgtaccatctgaactgcttttaagtgtacatgggctcttgttttgcaaagagggatttggaacttcagtgccggagctgaactgctctggacacagtgaaatcaagctgtcagtgcagtgaccttcccctcctgtactctaagccagttctcttctgaataagtgtgagcaaatgtttaagtggtatctccttgaaaaggtgccagatgatcagccagcctggggtgctcatgtaccccaataccgccctgtccagggcacctcaaaatgaagcacatcagaaaccgtcctcctgcacctacagtactggccttgtctgtggttcctacaagggttgatgtggatgcatcttcaggtggctccgacctctccccctctatccctaatgacctccctggaattctgagacaaggacatcagggtgccaaggccagggaccaaaacagcagaaagagtgtcccagccagcaggatgacccagcactgacacaaaaatagtttagagggcaaaggacactggtccaatcttgatttcatgatgtaccatatgtagtgaccacagataaggggccttacaatgaggagttatgcttgttagtaaactaaagtttgcatttcacacttttttaaaaaaattaaagatatctctctcactgatttgcaatccaaaatgtaatcaaagccctgagttcacccatgagactgtgtcgaggagcggggcatcggtctggggtcacagaacatcataagagaaggtgtggcttccatctgcccagtggccacgtggcagctgaggccaccctcctgatctgctcaggcttctggggcatgggtaacagtgagggggaggaagtgacagttggagagaatgtgtaccatgattggaacaagaagttggctgggcgcggtggctcacgcctgtaatccaagcactttgggaggccgaggcgggcggatcacgaggtcaggggttcgagaccagcctgaccaacatggtgaaaccccgtctctactaaaaatacaaaaattagccaagcttggcggcacgtacctgtaatcccagctactcaggaggctgaggcaggagaatcgcttgaacctgggaggcagaggttgcagtgagcagagatcgcgccactgtactccagccttgacgacagagcgagactccatctcaataaaaaagaaaaagaaaaagaaaaacgagaagttgccaagaccctgcctcttcctgcacagagcatctggttcttccatttcagcaggctcttactctgccctaccatatggtgccaaactgcctgacctcagcgaaggcccatcctcccagactcctgctctctccacctccacggatatctcaccatcattaggaacagcagttctttatacccatgtggaaaaatttccatcaatttatctgttgcataatttatattttaatatcaccaagaaatacagtggagtttaatatagaacataaataattggcgctatatataaatcggcaggtttgaggtagacaagtttgatggaattcccaaaagcaagttgattgattatttaaacctgacctggagtctcctagagtggaggaggggagcaggaatctccaacgcttgagatggccctgaaggtgagagtgttgtcacccagccggaccactgcccctcagcctcagccacccaccacctccctctggaaacctgggaggccttcctccataggaacagatttcatgggtttatgtagagcaacttcttatttagtagacaagaaaactgaggcccagtgaaggtaacaggttttccagtgactccagaagcagggcaagaagtcaggacctttcggccattttatttcctactgtatcactggctgtcactagataaacatgacccttgacaatttggggtggagacaagagtgtcatggaactgcagtggtagcaaaataacgttgggaaccaattgcctttgtccagtggggaaagacatacttttcagagtcaggattgggagaggaaggggaataacagccaagaatagatacacagaatgagggagaagggaggcgtgctatcccatcccttccctccttcccactccctgctgtttccagcaacaatcccactccccagccaccaccagggagtcatttctggccactgagcacctcttgaggcaaaagcttttctggaggccatggtgatggaagaaatggaggtaatttccatgtacttggagttgaggcatgcacacgcacatgcgcgcacacacacaaaccatctcaggatcctctgcccctagagcatttcctgatacacagcaatttttttttttttttttgagacagagtctcactctgtcccccaggctggagtacagtggtacaatcttggctcactgcaacctccacctccggggttcaagtgattctcttgcctcagcctcccaagtagctgggattacaggcatgcgccaccacacccagttaatttttgtatttttagtagagacggggtttctccatcttggcgaggctggtctcaaactcctgacctccagtgatctgcccacctcggcctcccaaagtgctaggattacaggcatgagccaccatgcccagcccacagcaaatatttattaagcacctactaggtgttaggtactgtgctgagcggtaggcttaggtttgaaataatggacaaggcagagcacctgtccttaaggtacttataacttagtgctttattccagtcagtcttagaaagctcaccaatttgggccaatatgaaggacaatctgatttaaggaaaaatcaggattgtaggcttaaaatgattctgtctcactttgaagttacataaacaaattatgctactaagtagtcttatagagatattcttaataagcagataaagatgattagtggatcaaagcagcttagtccccattcatatttcactgatttggcttatatgtaaatgatgattctaatctgtttgaaaacggttgcttctcctaagtcagttcttcatgaaatttgtttgcacaattaattaacatccatgtttaaggttcatttgttagtatgtcacagcttaatgtcagagctttctgtcttggattagaagcttccagagcaaagcatgttatctgtttgacttgctaagtatatggctctgcagccacaccatggtgcatcaacatttttaaaagtgagaatggtaatggtgacagtcatattggattgatgacaatcaaccttttacccttttagggtagaagtcattcagttactaactccttgtgacactgtatggaagagaaagacaagatttctgttcagtttacattcttcttagaggaagaggagaacaagatttttaaaattagattaaaatactgtggttttttgtttgtttggttttggttttgttttttttgttttttgttttttgagtcagagtttcactcttgttgcccaggctggagtgcaatggcacgatcttggctcactgcaacctccacctcctgggctcaagtgattctcctgcctcagcctccctaaaatactgtttttaaaaaaggtactcggtagctgttattcactcagtcaacaagtagaaacagtggggatagctctctgttgttcaggaggtgatgccggggaaaatctcatgcctttcagcccaccaaggtgcagtttatttacacacagattgtccaattcctcattattattgctgtccttcctcatcctgaagcatgaccaaagagaaaagctctgagccagaattaacatctttacttcaagtattcataaagaattcaaatgtgatggacaattctggatcccactggatcccagtagattctggatcccgctagatcccactacactcacaacttcattcttaaacactaaagttgggaaaagcaaattgtgagttctcttttattttggttcactgttggagggggcgggaacggcataaataatacctattcatcactatagctagcctgatagctttgtaaattaaattgttagctcttctgggaaattaactcatgtgacgttaaactccatagttaagcttacgtagagttgggggtggtggttgttttccctttcttcctttatttcttattttgagccttccttcaaccgatacctccagagaaaggcgacttggggaaaatgttctgactcttaatcttcgcggtttcttttttcccacggatgtagatttcgccagcctctggacagcacatgcgcagtatgctgctagcgccgccccaggcgcccggagctcaggaagcgcaggtggcgctgccagaagggccatgctatttctggggcaaacctgaaagacctcagacacaggggctttcttctatgccatgccactgttgaacttagcactccccgttcttgcaaagagtgggaactgttaggagaatattctccgttagaggttactgggcaggaaagtcatcccaaggacgtgtataaagaaagtgtgagccaggcatggtggctcacgtctgtaatcccagcactttgggagattgaggcgggtggatcacttgaggtcagaagttcgagaccagcctggccaagatggtgaaaaccctgcctctactaaaaatacaaaaattagccaggcatggtggcaggcacctgtaatcccagctactcaggaggctgaggcaggaggatcacttgaacccgggaggcggagttgcagtaagccaagatcgccaccactgcactccaggctgggcgacagagcgagactccatctcaaaaaaaaaaaaaaaaaaaaagtgtgaagccattttcattcattattaatatgatcacctttaattctgctgatgagggtgtgtggatatcattttctgttgtcttcattatcaaatggagaactagaaggggtaagcagcacattttggtttaattagatcagatttatgataggatggcatatcgctacatataaaatactcattttctggcgttcctggccagagatgtctacacagagcaaaatggatgaaaggacccacagtgagcagggaggactggtttggtcctgtagcccagagtctcctatcttatataccaggtctgttcttgagctttcagagtgcaagtagagaaacagaatttagcatccactttctccgtggagatcctgcatttcctacttctctgaacttcccctgcctgcttcatatgagtagacaggctcttctgaacacatttttgtttaagtttcagggacctgacgccttccaggcactgatatgtgtacatatactccacaagacgtatctatgggcaagctagaattcagccccttatgtttctagtggaatgttcatttcagtttccgtcactaggttgttagcttcttgggaggaggaaacatgttcttttcatctttgtaccctttcagtgccagctcagtgctagaaaggatacacaatgtggttgaacttaaaaaaaaaaattctatacagtccgtgtgaagtcttgatggggcgctgagcactgtgtagggtccgtcctgaaagaggcagctgcaaaaatgaggcagaaacagtgaaaacatggacgtgaccagaacccagtggtccttggctccacctgctcttcccagggtgcgagttgtcccagggttttacatcaggaagaaggtgacgcttcatgccacacgctggcaaagaggaaacagtgtccacattcctcactgaggaattttctcgaagaccttcttgtcctgtcctctcattttgcatgtaaggaaactgagggccagcaagaggcactaacttgtcatcccactttgtgggagaagacaaaagtttaaacttctgaatgtaaaagatgatttgttgtggaaaactgttaatcagaatttgaataagagattcgtaatcttttcctcccattttgcaacttttttttttttttaaaaacagggtttcactcttgttgcccaggctagagtgcaatggcacaatctcagctcactgcaacctccgcctcccggtttcaagcaattctcctgcctcagcctcccgagtagctgagattacaggcacccgccaccatgcctggctaactttttgtatttttagtagaggtggggtttcaccatgttggccaggctggtcaactcctgacgtcaggtgatccacccgccttggcttcccaaagtgcttggattacaggtgtgagtcacagcgccctgccccattttgcaacttttgatctcaattctgctggctctattttaaggtattaaatggagatggtaggcttgtgtatgtgtgtgcacgtgtgtgtgtgtaagtgtgtaggaggaggagaagaaagataatttttataaggggactttttaaaagctagcaacctttatcataattggtggacagccttggggcctcctggaatacctgtaattcctaattagcatcctgatttatggaataaaaacatgagataaaatgagggaattctctctggaataaatgccactgtctcaattaaccaaagggcaataagatggattataatgccagaatagggcttttgatcagtctttgtccaaaaaccacattttagttaagctcagcacaattagaccattactgatatcaggagaatggaaacagtaggtatattttaagctaacattcccagcatcttatctttctatagtctttctcttgttaatggatgaaaggaaagttaagcatgatttgttataattatcccattaaaatgggatcgatagaaatattttatgttaaaaaaatggtgagtccaaactgctgagttaattagaaagttttcctttgtgcctcaaacagaataggaaatgctgttcttgcctactgaattgttcgtatcaaatagaaaatatttgaatccctttctaatgcctcattgaaccaaaatgtattattatggagggggagaataattccgatacattctttttttttttgagacagaatcttgctctgtcgcccaggctggaatgcaatggcacgatcttggctcactgcaaactctgcttcccagattcaagcgattctcctgcctcagcctcccaagtagctgggattacaggcatatgccaccacgctcagctaattttgttttttagtagagagggggtttcaccatgttggccaggctggtcttgaactcctgacctcaggtgatccgcccgcctcggcttctcaaagtgctgggattacaggaaaaacaaccaaaaatagaacaattacagtagcaccgagtgctagagacaaatttcctgccaaatctcttttccagttccctcagtctgcgtctgtgttctgtgccacaaccaaagattcagatatcaattttgtccacttgtagctcatttgagatctgttaagcaacaacagtgaatgctgggtggattcgttagtggagctctgttccagctgtagctaataaagttattttctcgctgaaatcggtgatggtaaaattggtctgttttccaatgctagcttcttcagtttccgctgagttcttttctcctggagtgtgagatcacaatggcatgccttacaaaagagtgctcttgcctgctccgtcctggctgctcccaggccgaccctggctcctcaccagcaccctgctgtaaacgctcagctgccccttcccctagcagcagcgtcggcactacatttaggaccctttctgtatgtaccctgaaaacccaccggcgcagtggttaggctggagcagctcaggccagcctggggcaaaaggcagaggactgagaccatgcagtgagattggtgcagtcagtattggtggaggagctgctgggggccaggcacatgctggaaaagtggcgtgttatgtcccggggtctgaagcaagaatgggatcaggcagtgtggaaccaatttgtaaactcctcactcactgactgtcattagtaactaagttgctacaagctctttttttgtgagcctcaaaacaggaagcccagaagagtttacaacaatggaaactctcaggtttctacaggaaaaaggagaatgttgttttccccaaaggttatttccttctgcagcctggccatgtgcccctttccctcaagtttgggaagcaggacaaagggccctggggaatgccttagcccatgatgagctgagggacagtcatttttgtcccgtcatcatgcatttgatttgctccttgttttatgtaaatatataattttagacagcgtcttccttcgtcagccaggctggagtgcagtggccctgacacggttcactgcagcctcaacttcctgagctcaggggatcctcccacctcagcctctcaggtagctgggaccacattagccaccatgccctgctaattttttgtattttttgtagagacaggatttctccatgttggccaggctggtctcaaacacttgggctcaagcgatccacccgccttgacctcccaaagtgttgggattacaaacatgagccactgcgcatggcctgttttaaacattttaagaaaatattttatcatatttgcacaagaagattttcagtgaaggacaatgttttgaaaatccaatcagtaagatactcgctgggaggtatttttatagaaatccatggaaagctaatcataggaaatcggaaaaacagagagcagggtttgtagcttggcctttcccctaccttgttccgcattctataaaaagtgaaaaagtagcaaagtagcaccctacagggggctcagaggtgctggaggactaataacgcaccatttgcatgtccacgccacgcgaccctgcagtcacgctctgttacaagtacagatggtgaaagtgtggccaggaatggatgccggaagcccagaaggaagttggctcttgtctggaggctcccagggtggatctgcacagccttcccttggctgattcctgtccatcctgtggatatcagtgaaatgccaattccttggggaggctttccctgccaacctccccaaccccaggttatccaggctgggtgccccctcgtgtgcttccgtaaccccccaaagtttctcctcattgcattcatcactctttagatgactgatctgcgtaattccatgttcagtgggtctccttaacgaatgtaagctccatgagggcagggccatgtccttcttgttcccctttgaatccagagcactacacggtgcccaactgtcataggtgtcataggtgctcagtaaatactaggtgtattagccagagttctccagagaaacagaaccagcagggtgtgtgtgtgtgtgtgtgtgtgtgtgtgtgtgtgtgtgtgtgtgtgtggagtgggggtgggggattgactgattttcaggactggactcctgtgactgtggaggttggcgggcaggctggagacgcagggaagaggtgcagctggagtccaaaggcgggcagccgacaagcagaattccttcttgctcagggaaagtcagctttggttctattcaggccttcaactggttggatggagcccaccacattatggaaggtcgtctgatttactcaaactcagctgatttaaatgttaatctcatctaaaaaaatacctccacagaaatatgaccaaatatctgaataccggggcccagccaaattgacacattaccatcgcactaggggaatgaatggaatgatgacactggtttccattctgttgcgatgatccttcccatccgtataaggcctgacaatttccatgcccttgcacctatgtcatcttcctggattttttttttttttttgagacagtctcactctgtcgcccaggctggagtgcagtggggcgatcttggctccctgcaacctctgcctgctgggttcaagcgattctcctgcgtagctgggattacaggcacatgccaccactcccggctaatttttgtattttttatggagatggggttttaccacgttggccaggctagtctcaaactcctggcctcaagtgatccacctgccttggcctcccaaagtgttgggattccgggtgtgagccaccgcacacagcctccctggattcttaatacagccctgagaggtaggcagtggggcagtgcggggaggcaggggcttgttagatgctgcccatagatgagaacactgagattcagagagggcaaaataattcctagaggtgacaccgcttttcagagtggatggggtgacaccatatgtttgtttctactgttcttttccaaatcatacaacatatgagccattcatcttgtgccaagcactgttcagaaggctccatcctcatgacacccctgtgggaagcttccaccatcaccactcctcttttacactggaggaagctggaccggatctaaggaatctgcccagcatcacatgcctggtctgtggtggagctggcctatgaacgccaactctggaacctgtcctctggatggctgcatgagactgtctctctataggcaccttatgtggtcattttggtttcagaagaggtacagtaagcaaatgttcctggctggcgtgctgcagctgccttggcggggtggcaggcagggggctgtggcggaggctgaggctggtcgtcctcctctgccgctgacagtcccaagctctcttccctcatcatctcagatagctttgtggttgtcactgtgttgttttatatatgaatattttttatggatttttatatatggattgccgtgtgacttatgtttccctgccctaagcacaccgatgaaagtacattaatactcaaaatgactttgaaaagaccaaaagaaacaaaaaaagtcctaaattccgtgggaggaaaaaccatgatcctttagccctactccggaatagtaagaactgagagccaaagccaaggcggggacagcaccctgggagctgatgggctggttagtcccatcccagattatatggaggcacccgggtgattccatttcattgagaattctgtgtctagagcaccagacagtgaccacagaaatgtttaaacttcagcttttgtttaaagagatgtgctgtgagtatttatcgagccatggtctgtggggacactgctgggagagggagcatttctggaacccatcgtggctttcttccttgtctggcctcggcttttactttccttttttcatggacccctctatctcttgtgtccaaacccacctacttttccaggtctggctaagtgccttcttcctcccatgtcccacccctgtcccctactgagcccccttttctccgtgttttgtatcatgtaccatcccttgcccagatttctctgattaaccattcaccactctgttgctgtcaccgctttatgggtctaggttttctcctccactgagtctttaggctacttgagggtgggaatctttgttcctattgcgttcatatccctgaaaatgcttagccatatgtcagacagacagaactccctgaactgaaaaacacaaagatgtggagaatagcacagtccttatatgactttttccctgcttgtccctatcatttacccatcacctcttagtccatctggtcatccattgattcattcagaagacaggtattacgtatcttctatgtgctagttactttggggatacccagatgagttaaacatggtctctatccttaaggattccagaagttgctatcagaaagagttaaaaatcattcttcaggtagatagctcaaactaaaaatacctgttattatggccatcactccggcttaccatggcagataaggctgaaatttgtcccagataattggcttcctggtgagctttctccctccttctttttcactgagtatacgctaatattcctccagtattcatactgcatggtgaggacagctgacggtatagcagccagggaaggctgcacctgtgtttccattttagcgctttgatgtgctgcatgcggttgccctgcaattagttcatatgcgtgaatcacaatggcatatgtaaaacgtgtgctcatacagacccctctccaaagacctcacgcatcctttgcttctggagagaattcccctgaatgtatgtgatgaggaagttgggcttttcctctctgtgccaggctgaagcgaggggctttgctcaaggtcgtatagaaagtcgtctgcccttccaggccgtgctcttccattggaggcaacacctgggcgttctttgttttgcctttgccgcagagggagaaatgtcatatctttcaaaattccagtgtttcctagtcttctttgagaatgcccctgttaagataggtgagaagcaccaggggtaggcgagattcttggataatgtgtgtcctggaaggtggtgtattctggaatggggatgggaggaggggaaaaggataaagaagggaattcttttcgtttcaagcaatagaaattcaaactgtgatgcctcatggaaccagaccatgagaaggtcatgagcgcctggaactaagatctctcgagtgctccgggacgcttctcgcctcgtctcttacgtgtgcttcttctcacattttggcttaattcttcatttcaggccagctttctctcttacagctgccaccagcagactggacagactcctgtcctctctggccctaaactcaaaacttccaggagggagctcagatgagcgggcggttgggggtcaggaagcggctgctcagatgaagggggtgctggggttggggtgctcaggagcatctgcctgtgtggaagacgctatcctacaagaaggctggaaagacagacaaacgtcaccccctgcattttttgatggtttgtaggaagtgtcagtgagcatttaggagaaaaacccaagaccaggttacacagagcatgtcaggtctcaaatcccgacatgactcctgtcaaacccagtgccagggaggaggggagcccttcacccaatccgtatttaccgagcattgactgggtgcctgtgaaatgaggacttgggggggttcattttgtggaccactgatttcacaatcatttagcagtttccagggggagaaaagtggcctgcgtattcaacagagcttagagaagagactgtgtagggatttgcccagggagtgcagtagggagaggtgcatcaccaagaatatcggagacttctccttagcaggctcatcgtttccaaagagatggagatgcagtcccgagatagcgctccggcttgctggggacactggctccaggtggacagtcttacgtctgcctggcaatgctggctatgctggctatgctatgacctgcttcctctgtgaaacagctgctgaacaaaaatgcccaaattttagcacatcaatctcttcttcttcctcctcctcctcttcttcttcttcttcctccttcttcctccttcctccctcctcctcctcttcttcttcttcctcctccttcctccctcctcctcctccttcttcttcttcctccttcttcctccttcctccctcctcctcctcctccttcttcttcttcctccttcttcttcttccttctttcttctttcttcttctttaagaaagggtctgcttttgtcacccaggctggagtggagtggcgtgaacgaacacagctcactgcaggctcaacctccaaattcaagcgatcctctcaccttaggcccccaagtagctgggactaccagcatgcaccaccacgcctgggtaatttttgtatttttttggtagagatggggttttgccatgttgcccaggctggtctcaaactcctgagttcggatgatttgccggccttggcctcccaaagtgctgggattacaggcatgagccactgcatctggtgtttttgttgttgttgttgttttgagatggaggtctctgtatcatcaagaatggtctcaaactcctgggcttaagtgatcctcccacctcagcctctcaagtagctgagtttacaggtgcaagccaccatccccagccaagcacattaatctttatgaaaatgttttgtttctgcctttccccactcttgcaatggctcaccacagtcatcccattttcccagcagcgtggaactcacagtcagaagggcccattctccaaaattaaccccacctgagagttacattatgtaacacactgggagtgggggacaaggaacatctgtctccatctgtgccaggtgctaacttcctgtgtcgcccaggaacactcacctaacacctccgagtgcctccacaaaagtgccaggccatgtatgtgggacacttgctctgcagtgtaagcaaaaatgggtgcagttttaaaaatattgtagaattctagaactttccaaataagttggataatatcagcagttggtattcatataggttgaccttcacttggcagaacagtctgaacaggtgcgtagattttaagtagacttgaatttgaaggctaaggtcatccagatctctttgcggatgtggagctggaatgaagccctcctggctttgcctcctctgccgtcgtcgcagccggcaggtcccagctctcctctttcaattgctgtgtgaccctacggaagatattcagtttttctgggcctgaacttctttatctgcaaaacaggaaaacgaatcatacttcctcagagggtaattgtgaggctccaataactgtgctggagaaagtggggtatgaggcccggtttggggctgtgggagcacctcttccttctgttggtcctaggagctcagcgcttggtgggatgttccagaccaggagaggctgggactaaaattccagagtgatctatgggtgcagaagcttcagacgcctgttcaagagatgggtatcaggtgaggtgagtccatatttaggtctccagctaggatttaaacctataaggggaagaagcacaggtgagctacagtaattttggctaaaggtccaaactgaggccaatctcagggcatgtccctctaactagaggtaaggcatttagtcaacagccctccaagctcaaataggcagagggtagaactgagggggaatagcagctgttactaggaggctggtcactggcaaccttgggtttcaggagcgagaaatccatcctggatactgcgaacgcccttgattcttagaaaagtagggtcctggcatcaaagctggagcagtatggaacggatgactgcttagacacagggccagtgggtgatcaactacagcctcgtagatttctctttggaggactggagtgactcccaggctcagtaggggactctgtaggggactgagcttggagaagcccacggccaccctgcctccattccaaacaagattattcactccactcctgtttagctggtcacatggctcccccattccttgctctccattgcccttagtccaaagtccaaattccccagcccaaggctgcagggggctggctccctggcctctagttcctgcttctctcgcctgcccccttgactccagtgagtagtttttggtgctgcaaagaggacacactttctctcaccttcgggcctttgacctgcccgggcagggccctccccatcttcctcctttgctctgaattcatccttcttcttcaagctttaatttggatgttatcccttcaccccgcttccccaaggaagttccctcctgcccctgaggcctcttgccatgctgggctctaagtgggcatttatttctctgtgcagagtttgtccttctttgaaccaggtccctcctggacaaggaaggtgctagatacatgtttgtctagccacagggatcagagctcagaaggttgcggggacagggcatcctgcctgccctctctgaatgttcactttgagttacttcagttactctttacctggacaacataacgtcggggaaaactcatttatttgcaaaaggcaaaatacatgacactgtttcactcagaagcccctcagacccagcatctcgccaacctttgggcttaagaagtggtgaaaagatggggagagagtgactgaatgcatttttctgtctaggcaatttagtattacaggagatgctctcaaatccttgaccggagtgaaggcagagttcttgtcagttatgtaagaaaaacagctcattgttatatgatgcacactgaacaccatcgtgtgttttctcagtctttgtgtgtgcggacacgtggcatttaaattaaaatttggccaggcacagtagctcatgtctgtaatcccagcactttaggaggccaaggcagaaggatcgcttgagcccaaagttgagaccagcctgggcaacgtagggagaccccatctctacagaaatttaaaaagtagccagccatggtggcacacacctgtaatcctagctaaggctgagacaggagaatcacttgagcccgggaagtctaagctccggtgagcctgtgattgtaccactgcactccagcttcggccacagagtgagaccctgtctcaaaaatagaatattaattaattaaaatttaaggaattctgtttttactacggtgagtaacaaggttttttttttggtttttgggtttttgtcgagacggagtcttgctctgtcgcccacgttggtgtgcagtggtgcgatctcagctcactgcaacccccacctcccgggttcaagcgattctcctgcctcagccttccaagtagctgggagacaggcgcacgcccccacacctgcctaattttttgtatattttattagaggcagggtttcaccatgttggtcaggctggtcttgaattcctgagctcatgatccacccaccttggccttccaaagtgctgggactacaggcgtgagccaccgtgcccagcctatttttgtttttgtagagatggggggtcttactatgttgcccaggctggttttgaactcctggactcaagtgatcctcccacctcagcctcccaaaatgctgggattacaggcgtgagccaccacacccagcctaacaaggttttttgttttgctcctgtaggtctattttttttttttttccaatcagtattttcaatgttttggctccagacagatttcagtggtgcatcacatgttaccgacgtgcctcccgtgcctccctgtctgttcatctgctgtcgtctctgccagggatgctcgtctctcattcgtttttttggcgtggaaacacgctgctcagtcctcaggcccagctcccgtgtcacctgccacctgcaggccttcctcttgtcccttctccaggcactgtgcctgtgtcccctactccagaccgtgagttgtggatgaaaggggctgtatcttacttgcccctttttgcatttattcatgtggatacatagatgctcattcgcttcaattcattgaacatctgctactggccagggactttttcccttttggaaggagacccagataccctccagacataggtccggcctctcaggagttttcattctcctgagagaggagagagacttgttgagctatgcgtggagtgctgcctgacagcttgctattttctttctttcctgtgagataaaaatgtaccttatggtattactttattttaattctgccatgacatttgtggcggttgttttaagattcagagattactgggtgttgatctccttatgatactctcggttcctaattatgttagaaaaaaaagcaaagcgggaacttggcttttgtgttgccttcacagagtgtggaggttgaaaacatctcagcgcacttcacggaggttctcagagaccccataagtttctggaaaagtgggaaacgcaaacctgtcaacctgtcagtctctcccctctcacggaagcctgacatgtaaatctcaagttgttaaacctgctgtcaaatgagctgcctccactgaagactcccctccgctcctcgcactctcatcactgcccctcactctctgtccccacagcacagggacagcctccgcagactcccgtgtgtgtgctctggagagaaaagattctggatttgggcggtctcacctccaaaattgcagcccctaaggggagccgtgctaaggtgtgatacaggccatgccccttctagccccatgggacacctgactgatagcagcctgtgcagatgtgaggaacagaaggtggccccagaccccttaggagaaaccaaagtgcctcagagacaggacaagtgctaccccggaggccagtcaccaggtgacctgggagctgggaaccttttcagcctatgggtggctgtttatcacgaggggcattagacagacaggaggcagtgctgaaattcaacagcacaaagcaatttccagcttcatcttggcttattaataatgaaacagcaatagcgcaggcacaaatcaacagtaagtaggtgggtgggtgagacaagttggacatttggggaacagcctgggcagctaccgatacagagggaagccatttggtgtgtgtacctcccctcttccctgggataggagcaaacctgaaatgagaacggcagtcatctgcacacaaaaactaggttaggaaactgttttctaaggggccaggttgggtcactctttgtgacaagaaccgtgtgaaccacttcttacctgtaattctgactcagcattgatatttgaaaattcttccctagggctgggtactgagtactgttctgagtgcattacatacaacagctcatttacatacgtaatacattcacatacatcaatcatttgcatgtatcaactcatttatgtacatcaactcatttgcatacctcatttcatttgtacataactcatttgcatataccaactcattaaagttgtctcttttactagtgaggaaactgaggcctagagagtcatgtgcatgctgcatctctgcatgcttcctctgatggtttgatgtgggtcaatcctacgtctgtgcacatcttaacaactatcgtaggtgtagggtgcctttggtttactagaggtttcatcagtccacctgattctcactactgacgtaaatgtcagaggtggtcctgcctcttctcagtctccatcccaaggctctttacagctttctgtggcctgattttcttgctgtggatgctgaagggcactcttcagtggtttctcccagggccgttgcggattgcagctgtttcatacccagatgacctggggggcatcttcagtgtgtgcagatcagactcagcactgatactcgtcctccagccgtactttgtctccgcggtggtgctcagacttaaagcacttctcagctgtgctagtggtcccttcagagaacgaattatgctgaggcagagagggacctggggagggtagggaaggtcacaaattaaacagcagattagaggacagaaattcggtttgtggctttaatattttatactcagtatgacaggcagactcttcaaaaaaacataacctagtggcccaaatcgcaattttacgttatactttcaatataggaggaccctcacattgcttaaaaggggtcttcagggagaaatttacccaaaatttcatgcttggctccgtggtgacggcacatcctcactctgagaaccaggaccggcctcgggagtccaggttctgttcccagtttgtatgcacaccgatttccccactgtctgtcacaaccagtcaacttcccatgtgttaacagttactgaatctacctgtccgcacgtggccaagccccgccccccccttcccccatgctcttctctctgcctggccaactcctcaatcttggcaaagtccttcagaacccttgggtagtgtgagttaccttcctttgtatagaatctgaaaaatcattgccctttttttattagagtcaggatctcattgctctgtcacccaggctggagggcagtggtgcagtcatagcttactgcagcctcaaactccggcaggtctcaagtgatcctcctgcctcagcctcccgagtagctgggactataggcatgcgtcaccatgcctgactaattgtgttattctttgtaagagatgggctctcactgtgttgctgaggctggtctcgaactcctggctttaagggaatcctcctgcctcagcctcccaaagtgatagaattacaagtgtaagccaccacacttgtccatcattgccttttaatctttgcatcctgccacctccccagcacagccagcataggagccggcacttagtacatgtttgtttggggaatgaatgtgaggtcactagtcaatgattctgaaatgagtctattgaaggtggaaaccagcacaattcaaatgctttgcgttaaatgccagtcagtgtctcttcccaaagacccccactgaacccatcagatgtaaaatcccccattttatcaccgaacaacctgtttccacccatttcccttattcactaaacaacccgtttccacccatttctcttgttccttcttattgcagtgggggacgtgtctttgccttctttcaagggttaatgtttccaagtgggttctatcttctcaaggatcactggtctttcgcatataccctcttgctcccgaatcattaagaactcctgcccattggatgatgttgctgtatctccaattatattttgaaactttctccctctcacttactcctccacgtgtcccatttctctgccttcttaatggccacttctcaaacacatggctgacagattccggaggccttcaactcccacctatgaagcagccagtggcctcgggagtggggctgcttgagactgtgggaacgatgttttcgttaagaatggactgcctgtataatggtggtcccataagattataatactgtgtttttactacaccttttctatgtttaggtatgttgtttagatttagaatatgtaacgcaattaccgctgcgttaccagcaatcccaagaggaccccagaccctctgaaggaagcgggctcctgcaggacccgggagacagtgttgaacttgaccttgctctcctcctcgggtcaggcctgccgaccctgcactacaggttcctttttctctccctgtccgtgcatccatctgtttctgcactctcttcggtgcatcctctgaaccaccagaattaggttcctccacaccaaatgtgatcatttcatttcgcagctagattgctcgtgaacagctaagcaggtcacgctgagctcgacacagtccaatcccaagtaccagtcaggctcccaccgtcccttcctatcccaaaatgtcacctcccctgtgttgcagccacactgaagcctcaatgtcccctaaacattccagaccctcttgtgactctgagtctctgcccctgggttcacgccacttagaatgagcttccccccattttctgcgatacacactgtcactttccctgggaacagattcgacctgggcagaatgctcttcagtttgttcctatctctgccgggatctatatgttctggactctcttctacgacacggagacctttcccggagcaggaacggggccacggccgtgtttgcattttctgaacccaggatggtgccactgtggtttgttctccccgttcaagtgttgctgactggtggggagggacagcatcgcctcagtgaaagttttgggttaaacactgtctgcagtaattcaaaaggataagaaggactcctttcactgtgcatctttagacgaagcatcaacaaaggctttttcactgaaatccaaactcaaggtgtatacatgtcacctcccagcacagcaaatggcacagactcgagggaatgttttccttccggaacaacattataaagcagcagcccccagcctgtaggcaccagggactggtttcacggaagacagttttcccacggaccaagggtggtggtgggggatgatgatttcaggaagattccagtgcattccatttatcattagattctctcaaggagcgtgcaacctagacccccacatgcacagctcacaatagggtttgtgcttccatgagaatctaatgctgctgctgatctgacgggaggcagagttcaagtggtaacgcttaccttctgctgtgtggcctgcttcttaacaggacaccgactagcactggtccgtggcctgggggttagggagccctgctctgttacagagaacaaaatttgttacgtagggatcacttgagcccaggagttcaaggctgcaatgagctatgattgtgccactgcttttcagcctggctgagcgagaccctctctataaaaaatttttttaaagagtaaaatttgtatagtttttgggaatttactatggtgatattttatagcgctgtcaggaatgctctagctattggtgggccctcagagcacagtgaattcgagggctctgatgtattctgttgttttttttgggtttttttgttttttttattttgagacagagtctcactctgttgcccaggctggagtgcagtggcaccatctcagctcactgcaacctccacctcccgggttcaagcaattctcctgcctcagcctcctgagtagctgggactacaggcgtgcaccaccacgcccagctaatttttcctatttttagtagagacggggtctcactacgttggccaggctgctctcaaacttctggcctcaagcaagttgccctcccgggcctcccaaagtgctgggattacaggcatgagccactgcgccgagcctctgatgcgttcttgccggtcatttgtacagtgttgcttgcatgtgagttcttcttcaggtcgagattaagggtatgacattagtactaaccattattcaacctctgaaatatacgcacatgggacaaaggagataatttcatttacttatgtggccttactttgaagatattcatatgttagtccattttgcattactataaaaaatacctaaggctgggtaatttataaagaggtttaattggctcatggttctgcagctgtacaggaagcatggtgctagcatctccttggcttctagtgaggcctcaggaagcttccgatcatggcagaaggtgcaaagggagcaggcatgtcacatggcaagagtgggagcaatagagagaagggggaggccccagactctttaaaacaaccatttctcacatgaactaactgagcgagagctcactgatcaccaaaggatggtgctaagccattcataagggatctgcggccatgatccagtcacctcccagcaggccccacctccagcactggggattacatttcaacatgagatttggaggggcaaacctctgagccatatcaccatagttagtgcatgccagatgatttttgcgtttcccacaggatgtcagtgagcctttttctcagtcatggccagccccaacagagaggcaagatgagttcctcttggttgtgatgcctcttttcttttcagttcacactttatgccctttggcttgctgccaggtgctacctttcacccaaaagaaccacaggctcctcacggattttgcattccttcagggtcctgccagttactggcaaattcaatgataattgtgctcactgtataaaatactttctggaataaggtaaaatatgaatgaaaaaatgcacaaatgccaaacaaatacagttgcttgtgctgagattttgttttaaagaagaaagagaaaaacaaagaaattaaggacagcattgcgatcacttttcttcctccaaacaaaagctttcaagcgcaacatgttgatttttaaaattcctttctgggctgggcgtggtggctcacacttgtaatcccagcactttgggaggccaaggcaggcggatcagaagatcaggagttcgagaccagcctggccaacatggtgaaaccccatctctactaaaatacaaaaattatccaggcatggtggtgtgtgcctctaatcccagctactcaggaggctgagagagaagaatcacttgaatccgggagatggaggttgcagaaagccgagattgcaccactgcactccagcctgggtgacagagtgagactccaactaaaataaattaataaatacatgaataaataaaaaaataaaattcctttctgtagccactgtgagccaaaagcacgggcttaaactgcagagtgctgtgtgtgcactcacaaatcccaggttcccagagtggagagccctgcaccccagccgcggccaagggtcagaagtagcaactggtgattaatcaagtggctcctgtcttaggacagtcagcgtttattgtctctgcaggccagactatagaaataagcagacccacaaaagccagcaattaatatttccccggagagattccagatgctgccgggtggactgtgacatgctagcattcttcctgctcctgatttattccattgtgtggaagagcttccacagaaatgactctttggatttttcaggaaatgtttcaagccttcttattcagacaccctttcagcgtccagtgatggacgaagctgtgccctagagtcccaccttcccaaacagtgggcaacttgctttctccagcctcctgtccccttccgagcacccttcacccctcccatccccaggagtcgctgaataggtcccatgggagagaaatgacagcttgaagtgatgacccatcccaccccatcaaatgttggcattttactctggcctccaaaggcatggggggatgacccatggcaggaatacaggccttacagagaggttcactccaaccaaaccatgctgctcccccagtggcccaccatgaaaacctctggaaaaccaacttatttgccaaatgactcccatgagcaggcctttgcaaaatttcagagtgttgtacagctgcatcccaggacaaaactctttcttttcagtactaacagtgcaagtagaatagggtcgtggtggagcatcccattgtcttcattcctggtccactaattttcatctgagttaagagttttgggtttgaattcaagggaaatgaaaagttcttaaaggggccgggcacggtggctcacacctgtaatcccagcactttggaaggtggaggcaggcagatcacctgcggtctggagttcaggaccagcctggccagcatggcaaaaccccgtctctactaaaaattaaaaaaaatagccggggttaatcccagctactcaggaggctgaggcaggagaattgcttgaacttgggaggttcagtggaggttgcagtgaggttgcagtgagccgagatcatgtccctgcactccagcctgggcaacagagtgaaactccatctcaaaaaaaaaaaaaaaaaaaaaaaaaaaaaagaagctctcaaagggcctgagccaggcaccgtggctcatacatgtaatcccaacactttgggaagccaaggcagcaggatcacttgagctcaggagttcagcctgggcaacagagtgagactctatctccacaaaaaatgttttttaaaaattagccaggtgtggtggtgcatgcctgtagtcctggtgggtggccaagtcaggaggatcgcttgagcgtaggaggttgaggctgcagtgagctatgatcatatccctgcccttcagcctgggcaacagagtgagaccttgtctcaaaaaggaaaaagaaaatggcttgaaaggcatgtgagacattacatagtttgaggtatttcctttgctatatgcaaaggcataaaaatgaacagggagctagcggtttattgctggtccgaaccagcaacatcacagctggccctgggcgtcacagggtctcatgggggtaccttaagaggattcttaaatgaaactcagaacacagagaagtagttgattttgtgtcttgcatgttctgactcttcatttagtgtcacagcaagggtcaaggatatgggaaatcataaacaatcccaagagtttcatgatctttgagaatcttaaagcttcatctaagctatgcttttgaattgggcagaaccagaatggatacaagatgaatacagttcaaatgattctaaaactagagattaaatcctgtgaatttcctactctcagcaggaggagattacaactatttccaggtttaagatgatgaacatgattggttttgccccgtgctcactgggctcagatgagaaatagctttaaggtgcatccagggtttggttggttgtgaagaagaatattccttgtcgtcaatgaataaatgttgtgataggtcattagaggaggatctagagccctttgctggaaattgtttgaatttgaagccagagaagtaagcaagtaaccactttgttctccttctttctctttgtttactccattgtacattgactgtctcccaaagtatcccaccgagccttaagaaaaagttccccttaaagataacagaactggaggattcagctaggggctttttgattagtcaagaagcctttgattggatggacatgtaatcccagcactttgggaggctgagacgggaggattatttgagtttaggagttcaagacaagcctgggcaacatggcagaaacttgtctctacaaaaagtacaaaaaaattagccgggcatcgtggcaggcacctgtaatcccagctactcgggaggctgaggcagaattgcttgaacctgggaggcagaggttgcagtgagccaagatcctgtcactgcactccagcctgggcgacacagcgagactccatctcaaagaaacaaataaacaaacaaacaaaaaacaaaaattagctggatgtggtggtgcatgcctgtagttccagctactcgggaggctgaggtgggaagatcacttgagtccaggaggtggaggtttcagtgagccatgattgcaccactgcactacagcctgggtgacagagtgagaccctgtctcaaacaaaacaaacaaacaaacaccttgattgatgatccaatatagttcttttgttgttctttgggccttcttttttttttttttttaatgatcacttatctttcccttgagggaaacctacgttgtaaatagagaattttttttttttttttttttttttttgagacggagtcttgctctgtcgcccaggctggagtgcagtggcatgatctcagctcactgcaagctccgcctcctgggttcacgccattctcctgcctcagcctccggagtagctgggactacaggcgcccgccaccacacccggctaatttttttgtatttttagtagagacggggtttcatcgtgttagccaggatggtcttgatctcctgacctcgtgatccacccgtcttggcctcccaaagtgctgggattacaggcgtgagccaccatgcctggcctgagaaaaatatttttgatttccactttatagatgagagaattgaaattcaggttaatgatgccactcaggcttgaaacttcagcatcatttttgtgtttcttctgcacatcccacattcggtccatcaccaaattctgttaattttttcctcgtgatgttactggcatctgtctttttctcatcacatccactgataccaactggggctttctggatgattatactggatttttccattaccttccacatgctggtcttacctccttgatgcctcccgtaagtattttggatcttgggaatatgaattcatgtctgttcccttcgtttggcacccccatgggttgtgggcacagaggcagggaggctctgagaggcatgggccaggaaaggcttttcagagatttctgagcatacctgtgtcccttacaccttattctaattcacaccagctcttggtgtttgctcttcgactgtggacctctgtggatggtagacaatttgtgtgagtccacgagcccttcagtgttaaacatcattaaacataaggtcgcaaaagtcagctgatgctcaaactgaaattgttgtattttgttttgttttatgttattttgtttcccagaatgaggatatattggtcttattgtgctatgtgttagagccacatattctttcttctgattctgtgttcacattgccttccagatatcatcaaatctaacatgttaaaatctaacataatgagtgaaaatatatcagcgagaatgataatagtatctgctttctaatccatgtgttcatcatgggaaataacaaagctgcatcatatcctgtcttgtttctatcatgtcctcttctccagttagatcctaagtccctccatgacaaagacctggattcgttcacacatttagtgattcagcaaaacacctagtaagtaccccttgtgtggaaagccctgtacttgcctttggtcctatgggagttgcgttgcttgatgttagtgatgtacctaagggtggtgttaggactgaccggggctcccctcccaagccccacctatgtttttaatcacaataccatgcaacttccaaatcaacgctgttgatagaaagacacctacccagctctgaagagttatttggtccctagatcaaggggcagataagtcagatttccagaaagatagagcctgcctctttgtcattccatctccactattccttcactgatgagaaagtgatcagatcagaactgatgttgtataaactgctctgtaattcctgcctgattggcttttcttgagaggtgcctgtccattagcttttgccttccttttgtcaggctctctaaacactttaagtaacagaatcaattaagccttcctcacgattttagaaaactaagtggtagctcaggaggggagtcatcctaacaagctgtctgtgtagacagtggattctgtattgtcgcttttgtttctcaaaggtttgggtttggtcagaggttaccaaggaaccttcgctatatttccacagattcttttgtgagcctctagttcacgccctgtaaggacattcatccttctctgtccttgggagacgtaggaaaattatttcctggagaaatcaggcgcttgtaagagccagcctttcaaagaggtatctaccatcaaaggggctaatcgtccgagtgacagacacgcatggctggcttccctctttactctgccttgattgagacaagatgagcgtgctgctggccttagcaatgggggattctgttagaacaatatcctcagggaatagcttttatctgctaagtatgacaagtgtggcaactgtgcacagagtccagatctcacgacctcgctttgcaaaggctacaagaccaagggcttgtgtacctgccccaacagagacaggctgactcttactacgtggccgtaggaatggtttgcccttgctcaggacttatttacctaatgtcgtttggcctggaatgtttcagagcaccctttcatgcctggtcagggttgtgatcccttttggagacagaaggaggtagacgtgcttttgtgtttccgacactgaggacattgaggttctgggggattcatcacttagctcccaactcttattgggagcagaagtgccactggagtagggtggctggtttgagggtgtggccccgggaaaggtggcaggacacacttctcttgttctccagcccattttcaggcacggtatcctgcgctgctagcaccgtagccatcactgacctcaggaccctcccggtgaacactcagttaaaattcctactcgctgcagtgggaaattttatgttatgtgaattttatctcatgattaaaattaaaaatgaaattttaaaaatgaaatattcagttgcctttcctagaaggaatcatcccgatgatactattccttacttctcacattcatcccattctaatgcccacatttacttcataatgtattacctacgtatagtgtatgttgttcgcttcatttagcatgaccctatgaaatgcctgtgtgaccaaaagcagatcaactgataaggccttttgtggctcagatgtgtctttgcggggaaatggtcaggcgtcctctgttggcaagggcacctgtcccaagcagaaatggagaaacacgtcctcacctcctcctgccacctgctctgaacagattctgtagcgtaaaattctttataaatacacatatcaatggagttcttgacattttgcccagaacctgaggaagaataaaacctttcttgtccaactaaaacacacacggaataacaagcaaaagcaaaagagaaatcccaagaaaacagaccagaaacaaagggttatgctccgtcattgtccccaagagggttacacatgagactcacagggcaaattttatctaaattaaaatgctgatttttcacattacaggcccaaagtttaccgaggtcacagtgcttttaaaattaatgaggccgggagcagcggctcacgcctgtaatcccagcacttttggaggccaacgcgggtggatcacgaggtcaggagtttgagaccagcttgcccaacatgacgaaaccccgtctctactaaaaatacaaaaaattagccgggcgtggtggtgggtgcctatagtcccagctactcaggaggctgaggcagaagaatcgcttgaacccaggaggtggaggttgcagtgacccaagatcgagccactgcaatccagcctgggtgacagagctagactttgtctcacaaaaaaattaaaaaagaataataataatgagtgaagattagcttcctctgaagtcagttccttgtggatcatcttattgcttattttttaacttatttgatatctcactgacccctcccgaggcagaaatttgcttttgctcattgcaaactggccaaggaaaaaaaaagaacaatttcctctatagagtagttcccccttatcctcagatagccttccaagactcccagtgaatgcctgagacctcagaaagtaccgagccctgtatgtgctgtttttctgatctggtaaccagggcggctactgagtggttaacaggcaggcagtgtagacagcaggaggtgctgggcaaaaggaagactcacatcccaggcaggacgaaatgagatggggtgaaatttcatcacactactcagaatggtgtgcagtttacaacttatgaattatttatttctggaattttccacttaatattttcagactaaggttgactgtgggtaactcaaaccttggaaaacaaaaccgtgggtaagggaagactgctttaagatctgagaatgaggactgacatgttttggtttggctggtggtttcagatccaacctcagtagttcctagagaccatttaatttgtttttgagatggagtctcgctctgttgtccaggctggagtgagtggcgtgatctcggctcactgcaaactccacctcccgggttcaagcgattcttgagcctcagcctcccgagtagctgggattacaggcatgtgccaccatgccaggctaatttttgtatttttggtagagatggggtttcaccttgttggccagactggtctcgaactcctgacctcaggtggtctgcccgcctcgacctcccaaagtgctgggattacaggtgtgagccaccatgcctgaccgagaccatttaatttgaataagtgcccaagaagcaaaggactgagccaggcaagatgatctgagagcaggaaggtgtggccaggctggctgagccatgaacaggctggttgctccagggccggtgtctcccctggaaggttctggagttcaggctgtgttggagtccaccttctgcccctcaagtccatggcagggccgttgactgctgctcttgcctgagtctcctggttgcaaaggccaggcaaggcactgcctaacgttgtgactaacatcgtgggtgtgacggggagtcagggtggcttctctgttgccccaagtatgccctgcacatcaccatcttccttttcaaagaatggtgaaaataggaattgtgctctttagggaagattgtcttttttatatctttttcttttttttttctttttttttttttttttgagacagagtcttgctctgttgcccaggctggagcgccagtggcgcgatctcggctcactgcaagctccacctcccgggttcacgccattctcctgcctcagcctcccgagtagctgggactacaggcgcccgccaccacacccggctaatttttttgtatttttagtagagacggggtttcaccatgttagccaagatggtctccatctcctgaccttgtgatccacccgcctcggcctcccaaagtactgggattacaggctcaagccaccgcgcctggccttttatatctttttcaaagaaaaaggtaggctgggggcggtggctcacgcctgtaatcccagcactttgggaggcagaggcgagtggatcacctgatgtcaggagttcgagaccagcctggtcaacatggtgaaacctcatctctactaaaaatacaaaaattagccaggcatagtggtgcacacctgtagtctcagctactcgggaggctgaggcaggagaattgtttgaacccgggaggcagaggttgcagtaagctgagatcgtgccactatactccagcctgggcaacagtgtgggactccatctcaaaaaaaaaatgtagaaaaataaaaacaatcatctattcatggctaggtagaggtcagatttcactcactgacctgtttttagattttccttcgatattccaactcttagatatgtcaggttgctggagttgctgactgcactaacttctgcattctccaactttcccctcagagagtggcttgtctaaatcacccaaattaccatgtgggtgagaatgttggggaaatgaagatttaaaatccacaatattattagtgctgtcaatatcataatatcataaatgtccatacgaggaaaggagaccttggcagaggctaccttttctatctgttttgtgtgtgtgtgtgacattcttcatgaatgacttcttgaactatgaaaatgaggcaactgtggcctgaactctctcatttgcctcctccccttcctggcatttacttaagacatttcctgatgcttcccgggggtgtttcatgctggtgtctaagccagagatcacacctcccacccaccatgcctgcacctccactcctgcaaaggtttttagagtcagggtccctatcagtgtctaagcatcaggctcttcagaccctgacctttgaaaagtccaaatggctcttgagtgccccattttctcccaatctgaaaactgtaagaatgaaatataacaattaagcctcagaggatcacaagcgcaggtgatcctcatgagcccagactgatatttctaaattatctagatcttccttgaacatagactccagagttaccgggacgcagcgttcccattccactgggcagccatctatacgtgaagtgtcattgttggtggtttgggagttttattttccctttcataacacgtctcctgtctcctcagctcccccagaactccctgtaatcatatttgctatcagttgtgtttgtggaggtgtagtgaatttttcagggatgaataccaatgctgagaccctccaagaagacctgtgaggtcagcctctgtcagcgtgacagcccagtgggagggggccccaagctacacagcaggagatgattgtcacacgtcctggtgagagagcctgctcaccagctctggacctgcactccgtgtgcctggccagtagataggtttccctggtgttccccaggccttttctgcttcatgacattgattatatagctagcatttcatttcagtagggcttgggaaagggggttctttattgcagctcctgtaaaaacccatttccacacgaatcacctctggcctttttctgtctggcacattgtttagacaggaggggtttgtgtgtatcacttccctccagcctctcctaagtggaagcctgggatttggaaattgggatttttttccttctctctaaatgaatgccttgttggataccttgttgataaaatgccatttctcacatctttatagcttaaggggctaccttagccacaaggcacagtcccttattactgataagagctactgtcatttcacttatatactttgggagattcatttttgcttctcagcatcatttatgttatgattcatatctaaatttaaggtaaaattttatgcttcaccatcgacttttcaaagtttgtctttgaaaatgatttttaaaatgatctaatccaaacctctcagtttacaggtgagaaaacaaatctagggcagagtttttccacaggggcacgagtgatgtcatggaccagatgtttgtgtcgtagggggatgcctggtgcactgtagggcatttcctgggatctcaagcttctatcctctggatgccagtagcaccctccaagttgtgaccaacaaaaatgtcccctgtcacacagctaagtcataacagagtcaggcataagacacgggtgtcccgactcccccatctgccctttccaggttgggcaacagaattaagctctcaacccacacagagctcagagaattagtcaagagcacttccacaatctccagggagagaagagggtttaggagacaaaagagccaacagcatggaagagctttgtggaactctgggcgatgcatcccctacatggaagagctttgttgaactccaggcgatgcttcccctatacggaagagctttgtggaactcggcagtgcatcccctacacggaagagctttgtggaactccaggcgatgcatctcctcaccggaagagctttgtggaactccgggcgatgcatctcctcaccggaagagctttgtggaactccgggcgatgcatctcctcaccggaagagctttgtggagctccgggcgatgcatcccctcaccggaagagctttgtggaactccgggcgatgcatctcctcaccggaagagctttgtggaactccgggcgatgcatcccctcaccggaagagctttgtggaactccgggcgatgcttcccctacaaggaagagctttctggaactcggcaatgcatcccctcaccggaagagccttgtggcactcctggcagtgcatcccctacacggaagagctttgtggaactctgggcaatgcatcccctaaccggaagagctttgtggaactgcggcaatgagtccactctccccagtctccctgtctacgaatagaacttggcccagtgagtcactgactcaacttctgtgatcttctactagacgatatggtttagaaattcataagatgtgtgtcaggagttaacaggtttaggggaaagaacagaagaggcggaggaatgtctccccatgaatgctgaccctccacatacccagaacctgggactagccccttggcaaagactccatgagcctcatacagtgaatgggactcgttctcagccaggtagacatcagcttgggtctgacccccatccttgtgtgcaagtcctgattcacagagtttctttggcacttttgcttaagctgtaacaaacagccagtctgcacagggctcccttctgtctttccctttaagtcggctcacatttctctcctggtcacagctgtagaggacacacacagcacgaaacatgaggagtgtggcaagtaatgaatgcccccagggtattgccactttctgacagatgaggacaaatgtaatttccagggatttcatagctgagagattagaagctttcctgctgggcctaattctggagccaggtatgaacctgtgtttcccttgtataaaggtaaaagaattctgttactggggctgtggatggagccgattttaacatttgttttttgagctccatctatagctcgtaaggtccaccaggctggtccaaggtgcctttcctctagacacaggatttcatttagtggctgtgcctacatgcaaagcagcaacttcattcaactctctgggtctttgtcttagtgatgccagaaataacaaaatagaaactgaactattacatgaaatgacttttgggttggaaaaacaggctctaagaacagagttaatgaactgagagaaaatagtttctggttatgctactagaaactgtggtttttatcctcataaatcattgctttagggaaaaaaagtcctttctaaacttttcctgtcctgtttccttttcattttttgaatgaatgaacagtagggtattctctgtctttgagttattttcttcctagccacctggtcataatccagagggaaaaacaaattagatggattctgtgagctatatttcattgctattggtgtgtggatcacaatgctttattttccaccagttaaacgaagaacattctggaaactttgcacaaagaaaaattagtgtttatccctacagttgaaattttctaggaaaaaaaaatagcaacaaattaagttttgaaaaaggagagccaggtgcagtagggtgcatctgtagtcccagctactcaggaggctgaggcgggaggaccactgcagcccaggagttcaaggctgcagtgagctatgattgtaccactgcactccagcctgagcgacagagctagactctgtctctaaaaaaagaaaatttaaaaaggaggcttggctgggtgcagtggctcaacgcctgtaatcccagcactttgggaggctgaggcgggtggatcacctgaggtcgggagttccagaccagcctaaccaacatggagaaaccccatctctactaaaaatacaaaaaacaaacaaacaaacaaacaaacaaacaaacaaaccaaattagcccggtgtggtggcacatgcctgtaatcccagctgcttgggaggctgaggcaggagaatcacttgaacctggaaggtggaggttgcggtgagccgagattgcgccattgcactccagcctgggcaacaagagtgaaacttcatctcaaagaaaaaaaaaaaaaaagagctttgattttcatgaataccagtctatttctgaaggtttcccccttggaggaacagtggtggcgggctggccctctcagtcaaggagacgtgagcattccatgagacacgggtttcctctagggtctgcccctgaggtacctgaggtttggatacctctgcccactcccctctgccatgtttttccagctgtaccgtgccgataatcactgtgtcagctgtcattaccataatgctctgagcataactgctgtaacagctgggaaagaactctgcctttgcaaaacaatgctgcgtcataacacgctaaaacccccaatgtgcccacccaatatttcctatccatttgccccttctgcactccacaggcatgatcttccctttgccagtgggacatcagaatgagactctcttctgtcctccctctccttccccaagaacagtccttgcttgcaaatgcaaacagagaaaaagatactacccgagtgagcaggtgtttccgttggggtctgacaggagaaagacaccacacttagatcgggactatttagaaaagtatggatggagtgtagaaaatgaaaagggctaattagatagaccagggctagtcatagcagagtgccaggatggcctaggtccgaagggtcaaaaggagggaaccatgttggggggacagaggaaaggaaggtgtggcggagcctccggactcgcctcctccctccagagggcaagggggttctgctgatgcagtccaggcaggcccactccctggacaccaggagagtggaaaagggtggagactgagtctggagggcacggaggaaaattggctcagcatggattagaacagtctttcgcttcctggagcttaaaagccctccttacttacccttagctcctgccacctctctttgtccttggatggatacagcgcatgcctcctgcctgccacctcatctgtggtttctcatcctgtttgctgtcctccttcctcgttctgcccatgctgtcataatggatggaaaagctaaaggtgatttccagtcatctcttttgctgctgacagcatgaagtttgttctgctattagaatgacgcagacccgagacaagggttttgtcctgagttcattccattaatttctctctgcatagagcatctttccagcagctcctgcatgattaaattctggctgtgtgggacacaatggcacaggaagagcgttggccactcatcagccaggtcactaaaaggcaagttccacacatgaggagaaatcaaatgctcaccctttggacatccatccttttggtcctttgagtaacatttaaacaattgtttcttcagatacatggtccacactcaagagacctacaacagttggtatcacctggataagtattcaccaggctctctatgcccagttttttcccaagttccaaccaagagctattgatggctttgctcttgatcagaatagcattgggttttgctgcaaatatattcttgagcattatagtgatgaagaaagaaagaaagatagatagatagataatagagaaatagaagataggtagatagatagagaaagaagcttgcgtgtgtttgtttcaaagaatggggtcagttttcttacagccacctattctctcgcctggacatatattcagtgaatgcttctgtttgtaagatggctaactgggatatgggtcttacaggtcttcagttcctataagagtctacaaccacagcctcattaacacatgctctctggtgaaaagacattaaatggggagggaggaggtgtggatgctacgctggcttcaccacatgtaattattgaactttgtatatcactttacctttctgggtctcagggaccttgtctagaaacccaacaaggcaggctgtggtagctcatgcctgtaatcccagcactttgggaggctgaggtgggaggatttcttgagcccagaaggccgaggccacagtgagctgagattgggccactgcactccagcttctgcaacagagagagaccctgtcaaagagagaaagaggaaggaaggaaggaaggaaggaaggaaggaaggaaataaataagcaataagcatgaagtggcagttattctccaagtgaacagtgtggagtaactgccattttactggtactcaagtacttggtgtaactgctacatccaggcaactgctgagacttgagcaaggacctttacagcctttggaagtcccatccgtcagacacaccagggagcccgatgctgaacttcatgtctgtgtttgctgaatgatgagcaggtcctcttcagcgagagctacacgagctgtgaatttaccacgtgcccgtcaagggggtcattgtgttcctcactctgtcaataaaccacacagtaaagatctggataataggagcagaacagtttcaaaggacttgttacaatgtatcaagtcaataacttataattttagaaaatccctgaatacaaatttgcacaattttgagttgttttacaacttaccaggccgttaatctaagttttaaaagtctcttaatatacttaatcatagcctgtgcttttttttttaagtgctgaaatatgtttcagcattactgaaccacagcagcacaaggaaaaaacgactttaactcgttccataaaacttgcaaagcaaccataaatatatacagtgtggggtctgttttgtgcacaatttatatgcaataggctgggcttgatcgagaggatttatgcttatcgtctgtctccccaggcagacaattgtggtagaaaagaaaatgcacaggacctagagtcagggctgggtttcaatcccatttctgccacctgctttttgtgagaccctagggaagccttttgctcctttgaacctgtctcctacttaacaataatatgcccaccttagagggcagctgtcaggattgccacagagcaaggcagaggtgagccatctgcagatgcgtgctgaatttaaaccaatgcatgagtgacacggagcatgagagtggccagcatccttcctctctccctgcaccccgcaaaacaactccatcccccactctctctcagaggtggcagcggccataattcagacacatgcaacccagccagcgtaaccaccccctactcaccccctgaaaatagaagaagaaaggatttagagtctgggcagattgcttttaaaacatttccaaccttcgatctaatttgtcattattatttgtagagctttctttctcttccttcgtatctcctttcatatccggagcattcccagggaagatcccgttgctgaatactcgtgtctccagttttctacccggacttaaagatctactggtcctgcagagctgagctccagtggtgtgaaaggcacgtgagcgatgctgggcttgtggagatgagtaacacacaggcttgctttcaaggcactcacagccttacacatttgaaaatgagtttttcactggagcctgaaacttccagatttgaaaccatctccggggccaagcctggctgagactctctctctctgcatgagctgcctgccaccatcagttccccacccagatacccaagcctgaccttgacctgctgggggaaattcattatattctcgtttactccattttatagacgaatgtttcttatcatgaatgagagttcgttaaatcagctggttctaggtggagttcactagagccctctccaatgctgccggaggacctgttgccgtctgggctgtattgtaggtgggtggtatcataataagatccgtggtacacgaatgggcttcagggcaggcctgggttacatcaccacctcactttcggtgtgtcaaagctggaaaaaacagctggaaggtggccagtgttcgcttacccaacgaagcatgactttgcatctcctctaccctgcccagtgagggctccctgttttgaaggactggcatattctggaatgcttccaccaaatccaaacatcattctggatgaactgtggagcagttcaccgttcacagttcacaaaaggaccctctgtagaagcagaggatctttccctggggaaattatcctaagtcttctgattttaataactgatatagttcaagtatttgtccccgcccaaatctcatgttcactgttaatccccagtgctggaggtggggcctggcgggaggtgactgcatcatggatccctcgtgactcggtgccatcctcatgatagtgagttctcccaagatccggtcatttaaaagtgtgtgtttcctgccccgtctcatgctcccattctcatcacgtgatgtgcctgctcccacttcaccttccaacttgagtcagagctccctgaggcttccctagaggctgagcagatgccagtgtcatgcatacacagcctgcagaaccatgagccaattaaacctcttttctttataaatacccagacttgggtatttctttatagcaatgcaagaacggcctaatacaataattgttttccacatgaaataaacattgaccgtcttatccaactatacatgcttcttgactctagaaattgttgaatggaagtgctaaagattatcctcaaacacactcatgtgcacacagtttcagtgccagaacagtgtcctctaggaggaaagatggtcccagagcaattactggtttcctttaattttggcttcctaatgagtatcattttggtacgattccaatgaattgtttatttgaggaaagagaaaaagaaaagaacctataggaagagttggtttggattctatcgcgggcagtttatgcttctacgatagtaataaaagcaatgagagaaaaaagctacagaaccaaataaatatagatccaggagttgtacaacttttaaaagaaaaattctttagcctattgatccttcctaaggtaaacatttattttatttcagtttagaactcaagaatttttttcaagtacaactgaggaatagagtcagaagccacttcgattttgacaccatagaaacattctttctttagttactagaatcttttaaattgataagattggcattttcccaggatataacattcacctccactgtgtttttaatttgcaatagattttgagggaaagattccacaaggatttggccaacatgcctcctgagcagtgggtctcaagtgtggtccccagaccagcatgatccccatcagctggaaactgttagaaatgcaaattgtcaggccctaccccagacccactgaatcagaaactctgggaggggaaaccaacaatctgtgtttcaacatgaagtctgagaacttaaactatgcaccgttcttggtaagaaaataagagttttcctttgtgtgcgtatgtgaaaccaattccctgcaacccacagttgtttaaacaaaaacgtgtctagggagttcaaattaggtggccaattgccttataaaagtttacaaagtaaagagtctgtgctgtttccgttaggagacagaaacccaatcactaacttggagtatgagtcagaggcaggacagagaaatgtctgtctagtcggtgagctaattaatacgtgatcctgaggatggaggagccagggctgccgttccttctccactagggaaaaaaaaaaaagatgtttctctgtcaggcagctccctagctacctccagtatgttctattccatggctagaggagtgcagcctacatcctgtggatttatgtatattactgtaaaacaagctttctcttctcgagagttccgaagcagatctgtctctgattctttccatgaattcaaatacattgtcatccttaggtttcctaggtaaaggagactgcattactcatcagcatttaataaatattcatttgttggttgactgattcattatccttcatgccaatcacatggctgctactagcatgcatacagccgactcttaactacagttgtgtcatctacacaatccctgcagaaaactcattgaacacgtagtcgacacatttaaaaatgctgtgctgtggaagtgcaagttgcacaaacattttcatctttagcttcacttagaatacatttttttagttttttaatgtttttagagacagggtctgcctctgtgacccaggctggaatgcagtgctgtgtgatcatagctcactataacctcaaacttctaggttcaagtgctcctcctgcctcagcctcccaagtagctggcactataggcacacaccaccatgaccagtgtgtgtgtgtgtgtgtgtgtgtgtgtgtgtgtgtgtgtttgttttaatagagacggggtcttgctatgttgctgatttcaaactcctggcctaaagcaattatcctaccctggcctcccaaagtgctgggattgcaggcatgagccacctggcccatctataactaacttcataacactccaaattggaagaaagttggtggtgttattagcattattttacagatggagaaattaacacctggagttttgtgattacagagcagtggtaatcacccagttattttccttctctgtccctccagtggccctctgttgtctgggttaagtacagactttttagtttgaggaaaggagtccctccacaatttgtcattcctctattcttccagccaaatttcttacttctcctccaccctcaactacagtcaaacatcaaacaggccgggcgcggtggctcacgcctgtaatcccagcactttgggaggccgaggcgggtggatcatgaggtcaggagatcgagaccatcctggctaacaaggtgaaaccccgtctctactaaaaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggtgacagagcgagactccgtctcaaaaaaaaaaaaaaaaacatcaaacaatactcactgagcccttcccacgtgccgggctatttgccgagaacttctcatgcattatctcatttaatcctcatcacaacttctctcaggtggaggcatgattgccatcccatcatacgggtgaggaaactgaggctcatagaagtaccttgccccaagccccatggctacttgcaggttccaagacaccggtcagcctgcccccctgcaccttggccatgctgcccactcacctagagcgcacagctgacactgagtcctcttctgaacctcatccatgaacatatttatgaaatctttcctggccccaagtggaaatgccccctcatttgggtcctcactgaaccccagtacacaactcttttgtactactctattatgctggggtgtttttttattgtctcacctgataaaccgtaagccccttgaagacagcaactcgtttttaagctctttataaccccagagcctcgcacagtacctggaccagattaaggggtacttaacagatgcttagtgaaggaaggaatggatttctcacctggttgcttatcttctagactcatttggggagtggccaggagtccgggagagctgccggccattgttccgtcccgtctgtatcccttgggctagtttcttctagactgaggtttctaagtccaaacaagatgaactgtgcacagtgcctcaattagggaacagcagcttgagtgctttggaaatacaaaagtgtagtttgtaggttcaccttgaaggcaagatcagacagctctacgtaagccagagctctgaaacaaagcttcaggctgggaccactttgcagtctcagtgcctggtagtggggactgttctacagagccgtgatcaaacctccaactgcattctggtcttggaggaaagctgattccgtatgaagagaaaaggcctggtgagagtatttgcagggctgaagaaaagttaacatctatagtttggcaagcagcagctgcaaagcatccgtcccagcacatgataaatgcttctgacgtttccttcagacacagtgtgctaggaaggcttttaagttctcaaatgcaggagtctgccttattgatcaggtgcctttcattaaaggtttccaagcccctcggctacagaggaaacgctcccctcagcctcctccacagccccagcctttcatgcagaggggattatcattgttggaatacggcatatactttaatttggtgaggctttttgtttaatgcttatgatatgcacactggaacagactgggattaggtaattttcacattgagttggtacttccctccctaacccccatctgatcttccatatacacattttaagaagaaaataaagagaagacacgtcctcctaatgatcctccgtattagaacttaccattctgctttgaactcctgctgctttgagtctcccactgccagcaagcacttctctgccaggcggaggggcggtgaagggaattaaaggggcagtcagtggcttgcctctggcgggaggtggcggagcgtctcattagcgtttgctcctttcctccagctgggcttcactgggcccctcttcttatcaacccgtccttcacttcacccaggctgtcccctgcactcagaccccctccagtccttccaacaagatggcagcaggatgactgggactcattggagctaagcagagaattaaagttgcttttgttccaaacctaaaacttgaaaatgaaggaactcttacgtggaaatgccaccatctcccttttgttttatgcgtaaacccaactggttccccatcctctgggtctccttcctgcccctcgctggctcagggcattgtacatactgtgtgttcaacacatgctgagtggaattgaacagatgcagtcctgggaaagggggccttttggaagaactgatggggaaagaattggggtaactgtgggcagttactggacgttcttgctcttacttattggttgaatgagaatgaaagtatctaagatgtaccaagtcccagggatagtggcataatttctctgttcctccttctgactccctcttctcccctcttttagtgtggggaagttacgagaacgtagcgtttggtgcagtgatccattcagtatacgtcgggctcttaagaaagttaaatttacctaacatcctacattttagataagaccgttccagatttccacctcttgacccaaaagatcccttcggtggttttccttactagggcaattcccttagtttcttggattcttccttcctctccttcctggaactaagctgcagagtcccaggctggagaaatagcccactgcccaggggtattttagaaagggcttcccaccttccgcagtgggcctggagaaggacgccttcttttcaccaccaggctgtgatctcgcaggctggcaaggcctttatgatgaactgaatgcggtctgtatttacgtgcctgccatctgtccccaggcggcactgagaagggggctgatgctgtcacccctagctccttctgcaggtctcctccgtacgtgccactgccaggaacaaaattatcatctcatgggagctgcacacatttaatggaacttgggagccagcacagaccgttttcctcaaagacagttttataaagaaaatggactttggggaacaacgccagaaagacatccagtatacctaattattaggcgagtgtggtcattgcctctttgtcttagataactaggttgttgattacggtgctttgccaaactccacggtggatctggtagctggtatttctgggcagacaccagactgagttacttcttttcagagttctggacgttactgatctaggtgaaaggccagaagcagtgggatattgaaattctcagaagtggagagactgtggcaaggaggtacagaagacactaaatcgggtgccatgttagcaagctcaagttttcatattgatcatgcagtgagctgcagagaagaaaagcagctttgcctgggtcctgttgttctccaagccaaatagcatctctgtgctgacagacgagtctgcgtctgcagacgcagcatctcttgactgtttgctatttaacgacagtcgtaacacatgagtgagctttactcatgtgggccctttattaacaataagccgcctctgtggcggctgggccccgcggggtcggggggtgggggtgcccaacgtggcagggaggcctgcaaggggaggccgaggcgccggtggaagcacaaaccacccggcgagtcagagcaggggtcggggcccctggccgcaccgtgccgcgcatgcgcagggtcccggggtccctggggtcccgggtttgtgcccccggggcggctgggccccgcgggaggggacggccaacgcggaaatgggccctttattcacaataagtgccaaaatccaaactgaacacatctaaaaaaattctaattaaggagcgtccactgctgctttctcaaaaattccttctgtgctattaaatattttctctttccaatggatatttaccatttctactcacagtagtttttctaccaagtattcagaaaaacctccagttgtcacttacccagtgtttaccaaaaatcaggcagaagagcgtggtggaagttggaagaccttagtgtaacccgcgtctataaaaactgggcgtccaggccgggcacggtggctcacgcctgtattcccagcacgttgggagtccaaggcaggaggatcacttgagtccaggagttcaagaccagcccggacaacatagaaaaaccctgtctgtacaagaaatttaaaaattagctgggtgtggttgtatgtgtgcgtcatcctagctacttgggaggctgaagtgggaggatcacttgagcctgggaggcagcggttgcagtgagcagagctcacaccagtgcactccagcctgggtgacagtgagatcctgtctcaaaaaaaagaaaaaaaaaaaaaaaaattggatgacgttgggcaagtgtggtgtctgtctcagctctgtgagtgtaggatgattcagaatctaatgattaggtctcctgaactcctaggtcaaacgtggttaaagggagatccagggaagcagtgaggaatgggctcttacaacactgtcatggacatgggttcaatatgttggcaattattatttattgaggacgtactttgttttaagtgcttaggataattatttgcttaatagtcacgtaagtccttcaagataggcattattatcgccattttactaatgaggaaactatgttaaaataatatattcctggtcacacagcgaccaagagtcaggatctgtctgccttcagagttcatagtctttccagtagcctcagtaaaaagtaataatagctaatatttactgagcacttactatgtcactgacattgtggaaagggatgttatgggcatttgctcttttaatgatcacagtaactctgctaggccagtactgttattatggccgatttatagatgtggacagaggaggttaaacactcgtgcatggacacatactgatcaacgtacagccagcactcaaacccaggccgcctgtctccagagcctgtgcccccaagctctaggccatgtgccctgtaagtcgcagatgggacgctctgacagcgagtgtcactgaggtcggagtgggtcatcaggcatgcctcagaatcccattccccacttcattcacacctgagaacgcctgtctctggatgcatctttacaccagctcatccatttaaaatcagttccctaatacaacaagctgaggatgaggccccttctaactaggccaccgtcagagtcccaatcctttctgacagaccagcccccgacatgtgtctgtctccatccttgcagcctggccagccctgtcccacgcctgctaattggtggggggacctggccccccaagcctgccggccattagcagtgcctcacggggaagggctttcttccttggtttcaactccctccctccagcgcgcagtcccttgccgggcttgcctggtgacagactcgtgttgatgaagacctttagggaatttccttccccctccgctccccgaagcgcttcttagagcacatctcattaccgggctccattctcccgtcctgcacatgctccctcacacttagctttattgtgccaccacttgtcacctttcccggcccggtttttaataatgcaaatcttccctctctgatggcatcgctgctcattatttgctgtctggcaccacgggagctcacccagcggcacctcggagaagccagccgcccagggtgcaggcgcaggccccactgcccgccccagtctcctgagagatggctccgctctggctatgacccaagatgctcatggagggaagagcagtccagggccagggcccttccaccttcgccaggcaggtgcctttgagcaagtcaatctctgcagcctcaaaataggaaagatggtaataattattataataatatccccttaacaaagcagttatggggcaaccaaatggaagtaagatacgagaaaagtctgtataaactgtaagatttgtaaaacttgtaaagaagttgtggtggtgttgctgatggatgattgattgatttggtcaacacggagcagtcgctgccccaaagtaggcctggagggcaccccagccccctcatctgccctcccacccccaaactcagcatggaatcatatggctttggactttctccaggtggataaagccccctgatctttgaacatgtcatgcaggattattattgtgtgttttgtttgggcaaagaaatttaagccaatttacttttgttctgtaactcataactgaactgtgctcagagtctctggggtcctttcaggcatgggtctgtggttctgtaatggtaactatgggttgatggagcaatggctttgtaaaatatgtttaaaagctccctctgaattgagggatcacagcctccttagttgtcccctggatttcctggcattggagttatgtaagacctccatgatcattgccatctggaatatgactctttggtaccccaaaaaacttctggagtctttcagtcatatggaatcaaaaagatcttcctttggaagaagcaattttagatcactgatggaaattttaccagaaaagtattcaaatcttttccttttataaaacctgggtttgttttttgttttttaattatactttcagttctgggatacatgtatagaatgtgcaggtttgttacataggtatacacatgccatggtggtttgctgcacccatcaacccgtcatctacattaggtatttctcctaatgctatccctcccctagctccccagcccccaacaggccccggtgtatgatgttcccctccctgtgtccatgtattctcattgttcaactcccacttatgagtgagaacatgcagtgtttggttttctattcctgtattagtttgctgagaatgatggtttcctgcttcatccatgtccctgcaaaggacatgaactcatccttttttatggctgcatagtattccatggtgtatatgtgccacattttctttattctgtctatcattgatgggcatttgggttggttccaagtctttgctattgtgaacagtgccacaataaacatacgtgtgcatgtgtctttatagtagaatgatttataatcctttgggtatatacccagtaatgggattgctgggtcaaatggtatttctggttctagatccttgaggaatcaccacactgtcttccacaatggttgaactaatttacactcccaccaaaagtgtaaaagcattgctatttctccacatcctctccagcatctgttgtttcctcactttttaatgatcgccattctaactggtgtgagatggtatctcattgtggtgttgctttgcatttccctaatgaccagtgatgatgagctttttttcatatgtttgttggccacataaatgttttcttttgagaagtgtctgttcatatccttctcccgctttttgatgggtttgtttttttcttgtaaatttgtttaagttctttgtagattctggatattagccctatgtcagatgaatagattgcaaaaattttcttccattctgtaggttgcctgttcactctgatgatagtttcttttgctgtgcagaagctcttagtttaattagatcccatttgtcaattttggcttttgttgccattgcttttggtgttttagacatgaagtctttgcccatgcctatgtcctgaatggtattgcctagatttttgtctagggtgttttatggttttaggtcttacatttaagtctttaatccaacttgagttactttttgtataaggtataaggaaggggtccggtttcagttttctgcatatggctagccagttttcccaacaccatttattaaatagggaatcctttccccattgcttgttttgtcaggtttgtcaaagaccagattattgtagatgtgtggtgttatttctgaggcctctgttctgttacatttgtctatatctctgttttggtaccagtaccatgctgttttggttagtgtagccttgtagtataatttgaggtcaggtagcgtgatgcctccagctttgttctttttgcttaggattgtcttggctatatgggctcttttttggttccaaatgaaatttaaagtagttttttctaattctatgaagaaagtcaatggtagcttggtgggaatagcattgaatctataaattattttgggcagtgtggccatattcacgatattgtttcttcctttccataagcatagaatgtttttccatttgtttgtgtcctctcttattttcttgagcagtggtttgtatttccccttgaagaggtccttcacatcccttgtaagttgtattcctaggtattttattctctttgtagcaattgtgaatgggagttcactcatgatttggctctctgtctattactggtgtataggaaggcttgtgatttttgcacaatgattttgtatcctgtgactttcctgaatttgcttatcagcttaaggagattttgggctgagacgacggggttttctaaatatagaatcatgttatctgcaaacaggcaatttgacttactctcttcctatttggataccctttatttctttctcttgcctgatcgccctggccagaacttccaataccatattgaataggagtggtgagagagggcattcttgtattgtgctggttttcaaagggaatgcttccagcttttgcctattcagtatgatattggctgtgggtttgtcataaatagctcttattattttgagaaacgtttcatcgatacctaatttactgagagtttttagcatgaaggggtgttgaattttgttgaaggccttttctgcatctattgagataatcgtggtttttgtcattcgttctgtttatgtgatggcttacatttattgatttgcgtatgttgaaccagccttgcatcccaaagatgaagccgacctgatcgtggtggataagctttttgatgtgctgctggattcagtttgccagtattttattgaggattttcacatcgatgttcatcagggatattggcctgaaattttctttttttgttgtgtctctgccaggttttggtatcaggatgattctggcctcataaaatgggttagggaggagtccctctttttctatagtttggaatagtttcagaaggaatggtatcagctcttctttgtacctctggtagaattcagctgtgaatctgtctggtcctgggctttttttggttggtaggctgcgaaattactgcctcaatttcagaactagatattgatctattcagggattcgacttcttcttggtttaggcttgggagggtgtatgtgtccaggaatttatccatttcttctagattttgtagtttatttgcatagaggtgttcatagtattctctgacggtagtttgtatttctgtgggatcagtggtgatatcccctttatcattttttattgtgtctatttgattcttctctcttttcttctttgttagtctggctagcggtctattttgataatcttttcaaaaaaccagctcctggattcattgattttttgaaggattttttgtgtctctatttccttcagttctgctctgatcttagttatttcttgccttctgctagcttttgaatctgtttgctcttgcttctctagttcttttaattgtgatgttagggtgtcgattttagatctttcctgctttctcctgtggacattgagtgctataaatttccctctaaacattgctttaaatgtgtcccagagattctggtatgttgtgtctttgtgctcattggtttcaaagaaattatttatttctgccttcatttcattatttacccaatagtcattcagaagcaggttgttcagtttccatgtagttgtgcagttttgagtgagtttcttaaccctgagttctaatttgattgcagtgtggtctgagagactgtttgttatgattttcatttttttgcatttacttccaattatgtggtcgatttcagaatatgtggtgctgagaagaatgtatattctgttgatttgggttggagagttctgtagatgtcttttaggttcactcagtcctgagctgagttcaagccctgaatatccttattaattttctgtctcgttgctctaatattgacagtgggatgttaaagtctcccactattattgtgtgggagtctaaatctctttgtaggtctctgagaatttgctttgcgaatctgggtgctcctgtattgggtgcatatatatttaggatcattagctctgcttgttgcattgacccctttaccattatgtaacgccttaattgtctttttttaatctttgttggtttaaagtctgttttatcagacactacgaccgcaacccttgctttttttgtttgttttccatttgcttggtaaatcttcctccatccctttattttgaggctatgtgtgactcagatgggtctcctgaatacagcaccctgatgggtcttgactctttatccaatttgccagtctatatcttttaattggggcatttagcccatttacatttaaggttaatattgttatgtgtgaatttgatcctgtcattatgatgctagctggttatttttcccattagtcgatgcagttttttcatagcatgaatggtctttacaatttggtatctttgtgcagtgggctggtaccagttgatcctttccatgtttagtgcttccttcaggagctcttgtaaggcaggcctggtggtgacaaaatctctcagcatttgcctgtctgtaagggattttatttctcctttgcttatgaagcttagtttggctggatatgaaattctgggttgaaaattctttaagagtgttgactattggcccccaccctcttctggcttgtagggtttctgcagagagatctgctgttagtctagggaagatgggcttccctttgtgggtaacctgacctttctctctagtgcccataacatttttccatcatttcaaccttggtgaatctgacgattttgtgtcttggggttgctcttctcgaggagtatctttttggtgttctctatatattctgaatttaaatgttggcctgtcctgctagtttgaggaaattctcctggataatatcctgaagagtggtttccaacttggttccattctccctatcactttcaggtacaccaatcaaacataggtttggtcttttcacatagttccatatttcttggaggctttgttcattccttttcattcttttttctctaatcttgtcttcacgctttatttcactaagttgatcttcaatctctgctatcctttcttccgcttgatcgattcagctattgatactgtgtgtgcttcatgaagttctcatgctgtgtttttcaactccatcaggtcatttgtgttcttctctaaactggctattctagttagcaattcctctaaccttttttcaaggttcttagcttccttgtattgggttagagcatgctcctttagttcagatagagagatgataagggatcagaagaggccagtggtgaattaactctgtagcctagaaccttgtaggggtaaaaactatttatcatcacctacacactcttactgggcatttattgtggccaagactcgggttcctgtgtgtctgtagagggccttcattgtgggtatccacaaagtgagttgaaacaaagctcatgcatgagaagcgctgatggagttctcccttgctcctgccaccttcttatcatctgtagtctttttcttactgctgagggatccttccagtggtcacatttgcccatagccctcctgaacgcttgagtctgcagaaaacctctagctggacagcttctgggtagagaaacaggccatgaagagcctcctacatgtgcaccatgtggctacgctccgtgacgagggaaaaacaggaatatctgtctgctgtgatcacgtgtagtggtcacggtgagagatgacggggctgctcctcctcagcctccagtcaggctgtgtggcagcgatcacctccatgtcgatggagtgtctgtgcagtttgggagcgaggctctgcctctctcggtgagtgtctcacagttcctttctccctcagccccatgatgccgtccagaacaaggtgctgaactgattaatgagcaggacataaagacaactgctgtccagagcaacagctgtcccaatccatccgtggaataaacaaacagggcagagcgaggtcccgaccagtggggacttgggtgcaggaaatgccagtctcttcttgcttgaatcagggtgtcagggggccttcctggccaccactcaggctgttcctttagctttctggatcccattccctgcaggtctacccttgggagtgaaatagtgaccgtccctttgagcccgagagctggggagaaggccgtgcctgttaacagctgcctggaccctctctggagagcagcagggagaggcggggctggaggagatgttgccaagaacctaagggtgttagtgacaaaagcaagaactcctggcaacaagtccgagggactttcttgatcacaagtggtatctcctaagcactttaattatagcagattaagcaggaagtggagtgccggactaaaggaataatgatacaaaggaggtgaagcagaaaaacttaatttccttcctttaagggaaaaaaaagtccatttatttagacgcattgcaaagaaaagaatggagtgtggcctttcccccagctcggagctcagtgggtttttaaagaactgtgtgtatctctttggccagaccagcgactgggatcttcagcctctctgcagaaaatgagccgcaggctcgggatttcgttaagatgcaggagcattccttctggaccaatgactcactcattcagccccttctttcccgcttctccttgtcagccctcgcctggctgagctcatattttacattcagcacctctggttacccagaaattgcatgcaaaattgtgaaatagaaaagcagtgggctgtgggctccatcagctctgcctggcgttgcatcatccttgacttgcaatgctcagaggctgggctaggagatttgcttacagaaagcctgaaggtcccagggaccttcccaaagttgcgacttgaatgcatgctcttagcacacatgctgtgtaactggggcagatctgtaggaatgagtggaactgaaatcagaccttagaaagtcacagtgaataagaaaattgccagaatggaatgcagatatacctactggttactgtcctgtatgtagcggctgtgtgggatttgactgtgttttactaataggagccttgttgggcccagtgcttcataactagctctgtctgtcgggaatcccccacagtatcctgcttgtgattcacgctatccagagtccagggcaaggagttctaaaaccttatcatgttttgttttgttttgatacagagtttcactcttgttgcccaggctggagtgtaatggcgtgatcttggctcaccacaacctccgcttcccgggttcacgccattcttctgcctcagcctcccgagtagctgggactacaggcgcccgccaccatgcccggctaattttttgtatttttagtagagacggggtttcaccgtgttagccaggatggtctctatctcctgaccttgtgatccgcccgcctcggcctcccaaagtgctgggattacaggcgtgagccaccacgcctggccgttttgtttttgagagacaaggtctcgctctgtcacccaggctggagtgcagtggcatgatcatagctcactgtaaccttgaactcctgagctcaagtgaccctgctacctcaacctcccaagtagctggcacctgtaggtgtgcaccatcacacctggctatttttttttaattaactttttgtagagatgggctctcaccatgttgcccaggcttgtcttgaactcccacctctgcccacatgctgggcattcaattcctagatctcttcctccctcctctcttgacttgcctcctcctggatcatgatatcttatcattttccaatcacagcgttaatggtaaggcttgaggctgggcgtggcacccatgcctgtaaacccagtgctttgggaggcagaggtgggagttcaagacaagcctgggccatgttcagcactttacatgcccattcactgagtttgcacagccgcccatatgacgggcattgttattcctactgtacaggtgaggaaatgggggctctgagaagtgtgactgtttgtgggaggcagcagctggcatgatggaaaaagtgtaggcattggaggtgggatccaagtccagtcttccacccacaggttcagtgatgtggggcaagttatataacacagttttctcatctgtaaaatctggacaggcatacctacaccctggagcattgggaggattaaatgagatcgtgtagataacagcatagtcctggcatatgagagaaaatggcagggatctttctatgacctcagtgtgagaagcaagatctaaaccctcagaggtagagtgcgtcccacactcgggctccttctactgggacactggcttccggatctccacggagaactgttcttaagttagaaggcaagcacagcggggacacggtgcaggacacctgcggacccagtgcccttgggattctttaccttcagctttgctcactgcagattagtcctcatcgctcagcagagagagtcgagattggcaggaggatctccgtcttgaacaacattatgattctctgagcatttctatatgttgaaaatattttatttaaaaattacaaccacccctcctcctcaaaattgcatgacagagatttcaccaaacctgacaactgatgagacaaagagaacaagacacagagaggaatttagaaataatccttgtgcataccttccgaagttgccacatattactaaaattacctgtatctgtgtctatcctgctactctatgcattacatatctttgcatcccccatgcctagcacagtgcccagcacatagtaggtgctcaaaaaaagtgcccatcatttgttggactgaactcacaacacagtaacaaagagccagttagagcaaatgctgtcccttttcccaggactgtagcttccagacccgtgtgaggcctcagcctgatttctgttcaccttagaaccccaaggctgactgtgcatttccataagcacctcgctcgcctgcaggacggggctgggttggtggtgggtaccagaggtgctcagtgttcaatcacgcagaaagtgggctaaagggcagcgcctcctgctccctccagagatgcacttccattctctgaaacgacaacttctctgcactcgcttaatgggatcccaaataacacgtcgcagaccagtcttttatcactgttgccccttggaacacatttcgaatgctggccattaaaagcaggccatttcacggttctttaatgatgacactaataactgtggatttttgtctcccagagtcctgatgagctgagccaaggagtaaattacggagctaacttttatgtgcatggtttattgatctgtgagcttcaaggaaactgcaccagcccctatagtttggcagtccagactaccttttcatctgtgtaattgggccacgagggcgcagttaatattcaatttatattaataggaagacaaagaacatgatgtgccagctccatattgaagtaatgggcatatcaaaatattctacctggtaattataaataaatcagttttcccgtgacccaccaaggatgatgttgctaattcactgtgcatttcatcataatttatcctgagaaagttcagtgctgccatgtgcatgtatatcgcagagtatacaagggtgctccatcgtaaaacacccagctgtcttcatccatgctgtcgcccatcttttcttaacaggtgaaagtcatgcttcgcatctgttccaccttggctcgagatacttcagaatccagctctttcttaaaggtggacccacggaagaagcagatcaccttgtacgatcccctgacttgtggaggtcaaaatgccttccaaaagagaggcaaccaggttcctccaaagatgtttgccttcgatgcagtttttccacaagacgcttctcaggtgggtatcagccccctctcaggctcaggcaacgttgatgaaagggcaacgtttactcattcacaagggcccttgagctgggagggtgtcttctggagcattctgatggaccagttccttcaggagtcaatctgagctccaccgaatggtccagtgcttttgaattactggtgtcagaccttgggcaggatcagtgtgcacagatttcaataaaatctgtccttggggagaaggaagtgtgagccagtcagtggatcacacacagaagcaggaagataacagaaagggacaaggacaatgcgtcaaggtgctggtgacagatctagtaggaccctactcctgcctgggcattgtacgaagggaaaaaaaaaagtgtttcagggagctgattagaattaggccatctcctaggccctgtataagcacactggggttgagggcaagcctgtagccctagtaaggaaccagagtgcaaggcagggaaaccgaggctgacatgcatcctgtggcctggctcagtggagtgaaggggaagaagagaggctcagggacaggtgttgtattcgctgaattgctgccttacaaatcaccctaaaattcagtgcttaatacagtaagcatttatcattgctcatcggtcagctgagcagctcttctggtcctagctcagctcatttttatgtctgtgatcagctgtgggttgggcaggcagctctgtggatcttggctggatatcagccaggcgaaataagatcatcctatatcacaccataggcacatgtctttgggggttggctggccttacactggtgtagaatagccttgaccaggtcagctggtctctcttccacattgtcggtcgtcatccagcaggctagcttgggctagttctcaaggcagtttccaggacccatgcatgcaggtctctggaggcctaagctcagaattgacccaatatcacttctgctggattctactggcccagcttcatgagatggagaagagattgcttctaatgattggacgagctccaagtcacattgcaagggagttgcacccaggctggggtggagaattggggccatttttattaatctactatgagcataattgggaggctacttgggggcccagggtaccaagattactgagccatgggcagccaatgaactgcagacctcaccagatgctgcaactaaagctgctagtagatatctgttctcctttggattcaccctggagctttggtgaagatgggcctctaagtggcacgaaacagcacctgttccttcaggggagggagcagggacagacgtgtagaactgattgcagaaatgaataacccaggttatagaatatagcctactttgcctggagtttgcatctttctggtaagtttctagtgcttatcaagatttacattaaacagtgtataggataataactaataatctatagcagaacctgacgacaacagtgcgaatagttaccatttgcagcctctgtgaatttcctccaggctgcatctgagtagaggaggtggcgatgttctcacgggctcctatattacaccgtgggcacacagcacatgttacaggctccattcattaagaagttgagcatgcggtttccccaaagagttttacccaagaagacaaagtactttatgaataagttctatggtttctctccttattacattttttgtgtggcatatcacccaatgggctcagtaatttaaacctgacgtttggtctaacaaatggcctacaaataatttcattaacacagttaaaacttttcagaagcaaatctccacaagttgtaagaattccaaagcaaaccctaaatcaagcatggactatgaatgcgttttagatttattccagaaaaagggtccattttaattgctagtctttgtttacatttcacactcggctgcagagctcagtatgctcaatactggagtttcgctcatttcagaatgccttactttcattcacatttccaatgttataataaattacatgtctgtataaatttgcagttttcaagacatttcgtagacattaacacatttgactcttcctagaattcagtggggtaggaagagaggcactgatgttctcatgtgacacacaaggaaaccgagactcaaagatgaagtcacttgttcaaagtccctttcccgagcagacgtccttcctggattccccccgttaacctctctgtatcctgctcggtatggtggtgtatctttgacctcctgccattttatccaatatttcctagcagtgtggcctcaggcgagtcactcaacctctctggacctcagtgtccttcctcatctgtcaggtgaggacatgaccacaatgttcctcatcaggccgtgtgattcctcgagttgacacacaggaagtgctcacagcagagccaggaacacagcaagtgctcaacaaatgcggctatttttaccgttatcactgccaatattagcagcatgctgctggccagggcaaactcagccccacagggtgggcacccctggagcccccaagcctgaaaggagggagtgtgcggagtgggcctgtgctctccagtcctcattttcagcctgtgaagccgcagccactgtggtgacccgggcagttagaaattgtgctttctcttcgtttctaaggaaatcagcttcctgaagctaaacagtgattagaacagtcctgtttcatggttgcctttgagagccatatgacccttcagtggcttcggcagtcgctggctgcccctgttgggacacgtctctgctgggacacacccctgctggagaacctggacttgtgggcaggcagagccttcctgcagacctggcccttcccatgggggctgtgctcgagaaggctgcatgcctctccaggtcccaggggaagcagcaaggggcctccggggcccctgccagctcttaacacacaccagatggacagcccgctgaccacgctcttctcagtggagagccgggtgggaactgtgccaggggatgccgccccaactctgcacagcaggtctcctctcgcccccggcctctgcacgggtgactcagtgtggtccacacacagccaacattctcccaggtggctcaagaatcaaatacagcttattttatgtatagctcaaggtgatttctcagcctcctgcctcccatcccactttatgtccaaagaaggcttagtccattgggcagccttctgcctgctctgcagacacgcctctggcaaattccatcaagacgctactgcttctgtctcagggttagcactgggctctccttgcctaagtcctggggggtttgaaagatcctgtgtgccctacagcagccctgtcctgccaccccctctggcccaggaggagccccccgccccccgcagagttgctggggaccaccctggaacaagtgacagctgttggaagtgtggtttttcaattttagtttaggagagaaaactgatttccaaatacttgggttcactgtgctgctgaataacaacattcacggcccaggtgcccaccgggaggcacgctgccccgagggctgcaaagccccatgttagcactgcctcccggagctcccacgagccctgactccggccccgagacagaaatgaaagcaacagggcacagcgaataatgctatctttctgcttctgtgacaagtctcaggtgctaaacaaagagaaggacatttcccagatctccaagttagtccacaaaaccgacagctctgatggctcgcagagctctgtattagcgggtgttcaggggaaatacaaaacatcatcgagagcctggtccctgtctaggatttaataatcaaattggagaccagacacacacacccggccaaagaacacctaataacataccatgtggtgactgatactctatatgttgaatgtatctgtagcaaaaggaagaaaaggcaggttttgaaaagaggagcatgggacgggcgcagtggctcacgcctgtaatcccagcactttgggaggccgaggcgggtggatcacctgaggtcaggagtttgagaccagcctgaccaacgtggtgaaaccccctctctactaaaaaaatgcaaaaaattagccaggcatggtggcacatgcctgtaatcccagctactcgggaggctgaggcaagagaatcacttgagcccaggaggcggaggttgcagtgagttgagatcgcaccattgcactccagcctgggcaacgagactgaaactccgtctcaaaaaaaaaaaaaaaaaaaaaaatgaggaaggtgtgaattgaaaatgaggaaagagatcaggagagaaagcagatatatatcacaaacctcttgcttacgtgagaactacggtgtttctcaaggtctcacttgtgaaatggtgggtcacctttttccctctcataagcctggcctgtttaataaactctatgtatacgtgtgtcagcagagggtgagtggagagtttaaagaccttatccgggaccccagaatggcagatgagggaagggaatgaggttcatgagcacactgtgcccccattccagcctgctcctgcctgctctacagacgcattcgctgaaacgtaccacggattagcagaagggtggtttgcagtgcatgtgcataatgctcaggcttgcaaagggcggaaggtcgccaggggttctgagcatctccaaaacttcacgacagaggccaacccacctgggaacacagtgacactgggacccgaagccccaggaaggtgggctcactttcgttgttagtggtgtctccgctgcgaggtccattcacggctcgtgtctcctcttgtgtctgacaggctgaagtgtgtgcaggcaccgtggcagaggtgatccagtctgtggtcaacggggcagatggctgcgtgttctgtttcggccacgccaaactgggttcgtgagagtttcactttctcatgcggctcgttgagctccctgtcatcccatgcattcctctgtctccctcccagagttctctgatgacaggaagggctgcgtttctcttaggtgttgagctgaataaccaataacaagttatacgacgaaaacctatgttgttcattgtaggtggacacccattcatgtaggaaagccttcaagtccaaatagatggaaagagaagtagcagagttgttcccacttggtccaggtcagagtcaagcccagaaggcaggcaggaaaatattcatttcctgagcagccgctgtttgggaagcagatagggccccttgcaccaccgcacccatgaggatgtgggttggtggttggacccctgtaaaagccagaggagcaacctccaagcaaagcccagagcccagggcgcgtctggagaaagcagtgcacaccgtcgggaacactccagcgctgaagcgtctgggaaaggaggcagcagagccccccaacaaggggttcataaatccccccacagtcccatcttacttctgacctgtggccatctgctccccaggccttgcccttacacgcttgatatgtttagtgaattgaggagcttcaaaaactgtcccttggcagagattccaacagaggccttgctggagctcacagaggccagttctcagccaggacagaaagccattgcctctctctgcacttccgtcctccccagccctttctcttgatcttgatgtaagcagtgatctgggttttaatagaatttgctcatgccataaaaatatacacagcatttaacttgagacaggatataaagtgtgaatatgtggacttaatctggggggtaactataaaaagaaccataatgatgatgaaaaagcccagccttcccactgtgtgtaaagcagtgcaggaactggatagcatgtgatatttggggtcctcctcaaggtacatggtgatttaatcttgtcacatgtctgggctcttgctttgtttcttttttttttaagagatggctctcagttgcctgggctggagtacagtggcatgctcatagattactgtaacctccaattcctgggctcaagtgatcctctcgcctcagcttcccaagtagctggggccacaggcatgccccaccacacccagataatttttaaaaatttttcatagaggcagggtctccgtatgttgcccagactggcctggaactcctggcctcaagcaatcctcccatcttggcccccacaaagtgctgaggttacaggcatgagccactgagcccaaccagcattctttattgtagccatttagttagtaataccagaaaatgccttctgttgttgtcaaatactatttctctcatctttttgttccttctcttcccttttccccccttccctgtgcctttcttctatatccttggcatctattttggagactccgtggaatgatgcctggacactgaacctgcttttcttccttccctggttctcccaggaaaatcctacaccatgatcggaaaggatgattccatgcagaacctgggcatcattccctgtgccatctcttggctcttcaagctcataaacgaacgcaaggaaaagaccggcgcccgtttctcagtccgggtttccgccgtggaagtgtgggggaaggaggagaacctgcgggacctgctgtcggaggtggccacgggcagcctgcaggacggccagtccccgggcgtgtacctctgtgaggaccccatctgcggcacgcaggtgattgcttctgaagcctggctcgccccaaggtggctccctccccacctcagaggctggggcagctccacccgtgaatcactgaacctgtaaactcagaggcttacgggtgtttactttaaagtggactggaactttatggcctgcagctgtggggccatcggcttgcccagtctaaatatttgtaccttgactctaattgacaatgagcagggaccacaattacagcatttgggggagaaatggaattcactttctttatgcccctttcaaaaaaaaaaagtaacaatctttcttttgtttaacaacaaaccggaatatttactgctctgcacaaatagctagagccattacggggctgttgatgactctataaactgtgcttctggcactggtttacagccggattagcagtgctgcaggaaaaactaataaccactttctaattagaaccgtgatataattgctagaactatggaagccaagagaagctccagttcaccatttcaggatgctaagcctgttgggagggtctctcctttgctgtttgacaacagatgtaggaatgacccgggagctgcaattcattcatatccagaataatcaatccttccagtctctaacagtaggctttattttcccgtgttgtcagatgcctccttttgtagataggtgttccgtttgataagtacctgcctcttcccaactgggattgtttgcacaggtgaggatacctcccgtggcctgttatactcattactcaaacctgaccatgctcttcccctgcttaaagcacctcagatccctccatttccctgagtcctctttcgtctgcatctgtcacctcgaggacttgtttaaacactgatcgctgggcacccccccagagtttccaattcagtaggtctagagtagagctccaaaatgtgcatttccaacaagttcccatgagatgctcatgctgccggtccagggatcacagttggaaatcactgttctgaggcatcaaatgtgcagagacagtatctacacagtgtctgtgatgcaatcagtaggactcgacccactgctcctgttccaggcattttctagacattcaaatatgctttcacccccattcatttttagaacttcattgatgaaattccactaaggggtgaaaagtctggttaaatgaaggctaagaaaaagaagaaaagaccaatattccctttaattcttgttgaaaaatcttttaaattctttggtttatttttccatagcgagacaaaattttgaacacaaaagaatctctctttgaagtctgaggattttgatggcctcaggttctaaatattggctcttacagttcaaaattatttgtatagttagagtagaaaattgtcagaatttgtaccaaccttaagacatgtactgcaaattagttctttgaacaaatcagaaacatgagttgccttttctccccaaaaagaggagtgctggttcaattctgttaatgtgatcgttgtgattcaggtttaaaataattgccaagtattttcataagattcagacgcattaccctgtgtgctttctttaatcaattaatgagtatgccgggagcatggattcaggaactaaaggtaaataggtatctcctaaatttagatgagacattcaagtatcgtgagtgtttgagggtgccctttacactggtttcttatttataactatgctagtaaatatggcctaaaattggctttaattaaataactgcaaaactaggagtcaaatgaaagctaaccaagtttttttacatctttgggacaccactgctatgaggcctcaaatcacattttgcaacctacctgtctccaaacaatctaatctttggactcaagatgcagtcacatcgctcctgttttcttaggtaaatggatagccaggggtgttggtttgccgccctctgcagagataaggatgagccatctgctcccagcttttcacacccactagttccagattctacttagactgtaaagtaggtaaaaataggtttcatccaataagtatgctcaatattaattttcagaaatgaattaattaagctgagaattgcacatgagcatagcaccttgtttcagaagggttttcagccttagaggggcacgtggctttactatacagaacacacagccagctgaatggtgctggggacacccaggcatgagtgacagcaagccctcctcagcctgcagcctcatctcttggcttctgtcttccagctgcagaaccagagcgagctgcgggcccccaccgcagagaaggctgcctttttcctggatgccgccattgcctcccgcaggagccaccaacaggactgtgatgaggacgaccaccgcaactcacacgtgttcttcacactgcacatctaccagtaccggatggagaagagcgggaaagggggaagtaagtcggccactccaccctcctgcctccttagcggctctggccccagccagaaatcccttgggcaaccatgacctttgtgtgtgtgtgtgtgtgtgtgtgtgtgtgtgtgtgtgtgtgtgtgtgtgtgagagagagagagagagagagagagacagggtcttgctctgtcacccaggctgcagtgcagtggcacgatcacagctcactgcagcctcaaactcctgggctcaagtgatcctcctgcctcagtctcccaagtagcttgggactacaggctcatgccaccacacctagctatttatttggttatctttgtagagatgggaccttgctatgttgcccaggctggtctagaactcccggtcttgagatcctcttgccttgatctcccaaagtgttgggatgaaaggtatgagccaccatgcctagccaaacttttcttaatagactacaatatgcagttcagtgactcgtaattcaagataattatagtatctgggctgaagttcacttttgaactgtccagggaaaggagtttgctttggtaaaggtaatttacaaatgtcattgccatgagaatgtgagaggtcaaagttacaaaaagaaaacaactgcctgacagtatctttttgttcacagacctcaaaaatgctcctcaagaaagaccaacatttatccaccaaagcactccggcagtgtgttatcatcattagctcgaggccactgtatggaccatgttttttaaaatagcatagaaatcagacttttgaataactacccagaccctggctgcctccctcaaatcgtcagtgaaggtttactgtcaaaacccaggtacggtgcctgctcttcgagtgagctgccctgccaggaacccaacactgtgcccctacagacccctcttggctgtgtttccaaagtcagcccgggctggggtgcaattctctgccttctgtgaagtagtgtttactctatgcccaaaagagttgagcaccagatcagctgaatgtctccagtggggatcttggaccaggggcaaagtggtctgttgatttcactgggttcctaaggcaggttgtgggtaacggggctgctgggctggccgggcagtggcttccgtggttcctccatgtcccgctctgccgggctttcaatacacaggcaactggctcccagcgctttctgcatgattgtctcaaagacactggatgccagaaaaacaatcagaaaactgagttaagagtctaaccctggactggaaattgtaaagctcattgagtaaagcagagatggtccgcaaagctgttgtagatgaagcctagaatgaagacatccaagtaggaccaggcgtggtggctcacacctgtaatcccagcactttggaaggccaaggtggttagatcacttgaggtcagcagtttgagaccagcctggccaacatggagaaaccccgtctctactaaaaataaaaaaattagctgggcgtggtggcacacacctcccagctagttgggggtctgaggcaggagaattgcttgaacccaggaggcggaggttgcagtgagcccagatcgtgccactgcactccagcctgggtgacagagcaaggctctgtctcagaaaataaaaataaaaagacttccagctgggatctatggacaggctccccctgatttcccctaagcctcctcgtggctcaaaagacctggacaacagtactcctggggagagagctctttgcgggcttctgctgtccccaggcaaaagcgcctcccttcccccacctcggtgcctctcttcctactctttagttactgttgttaaaatccaggtttattgcagtataaggtacattcaccaaaacatcactttgatgtgtctttagatgagttttggccaatctatacagtcatgtagccaccaccattatcaaaatagagcataaggctaaagttccctcttgccgtttgtcccttcccctgacctctagcccctggcaaccacggatctgattgttgtcctggttttgcgtttatccaggatatcgtgggaatggactcgtgtggcccagatgtggccttttgtgtctggcttctttcacgtagtgtcctaatgcatttgagactcccccatgctgcagcacgcgtctcttgtttcttctggttcctgctgcctgttctgcctgctcctttagtttttttgtttgtttgagatgaagtctcactcactctgttgcccaggctggagtacagtggcgtgatctcggctcactgcaacctccgcctcccgagttcaagcgattctcctgcctcagcctcctgagtagctgggaatacaggtgcccaccaccatgtctggctaatttttgtacgttaagtagagacggagtttcaccatattggccaggatggtcttgaactcctgacctcgtgatccacccgcctcagcctcccaaagtgttgggattacaggcgtgagccaccgcacctggcctctccttcagttttgactgggcctggaggcttggttcctaccctaccaccaggacagaatgaaaatatccacagctggggctggagttcctctaactggggctgctttttatggctctgaaaatcagccctgagctgcctccagtggctgctgtgaagaaccgagaggttctggtcctcacttacagcgggcgaggcgccccagggaagtggcccattagcttgagggcagctctctcgacagcccatgatggtgagcaaagtctcactggagaggagccgaggatagtgaacgggaatctctcgggagatgtattcttggtaacaggctcacaccatgtagagcgcttccgtttagaatcacgttcttaaagaaggaaacgcattcggatagggatgaggagatgcagacctttaaaatcggatagggatgaggagatgcagacctttaaaatcggatagggatgaggagatgcagacctttaaaatcggatagggatgaggagatgcagacctttaaaatcggatagggatgaggagatgcagacctttaaaatcgacagcacaattgcatccacatttctcctgactgtgtgggagttggccttgaaccctgccctcactgttttctcctgggtagtgtcttcaccctgtcaatgtaagagtctgacaaatgtttagtttattcttttaagcagctgtcagtaatcatcatcatcagagcctgcaggactttcttgtactttcagtaaagagtgactcgcaaaacatctaacccttgagccaaatgactcccaaatggcactgatcagaaaaacttgggagatgggattatctctcctccttccaggtttcaaaccaaactgaggacaactctgttttcggttttgtactttttttcttttttgcagttctgctttcgatttggaatctgaaagtagggagaaatcttgaaaacaaggaaacagttcattaaatgacttcaaatataagaacttgaaattcagattccacaaaagtttaggccaagacattccctaaacccagtgatccaccccaaatcagtacctaaggaatcctgcacccttattaaatatttaatagccagctcatcttcttcctatttttaagttgtgaaagagaattgcttttaaataatgcattcaggttaaaagaaagggcaaataccacgaatggtttccaaaacctcggttaggtccttcctaatgtttcagtggatgagaacaaagaaggggaaggagtccaggggtcgtgcgatcggcagacctgggggacatctcttccctcccgaggggaaaggatcccggccagaatgcacacggcctccccgcctgggactcacttgacttcagtgaatttataactgtttaaaatataatgaggagatttggagggttgtttaaaatggaaattttgtttacttacatataagtaataatccctgcggacctggcagccagaactcaattaggggaaagtttattaattagtcaccctgcagggaagccattagaagagatctctgccgcaagaactaaatagactctgtgtgcgcctctgaatctcatatgcacacatgcattttatacattttacacacaaatgcatcttacatttataattttacacacaaatgcattttacacatataagtagacagacaaaaaaaagttttaaacatttccagtcaaaatagaaaagtctttgttgatgtatccctgttttgcagatagcactaggttaagcttaaaatatctccctgtttaaaagctcattggaattagtgggactgatccttcagcctcatggaggccttcctctgctttgcgaagctaaatctgtaatagcttgagagcctcctcgggaatcccagcactgggaaacagaccctgaagccctactgatcagagagctgcttctcataacgacgcgtgtactgggcacctaaaacaaggtggtgcttgggaccagaagtgtttcagatttcagattgttttccgattttggaatatttgcatatgtaatgatcccttgggaatgggacccaaatctaaatacagatttcatgtatgtttcatatatgccttatagacatagcctgaaggtaactttatacaatatcttcaataattttgtgcatgaaacaaagtttttactgcattttgactgcaacccctcacgaggtcaggtgtggaattttccccttgtggcatcatattggccttcaaaaagtttgagattcttggagtattttggatttcagattttttgggttagggatgctcagcgtggactagtgatacttcagggtaatgcgctaatgatacggagatcgcacctgtcctgttgacaaagataatttcaaaagccccacttttatgagtaatctaagcatgcaagcaactgttgctcaaggtccacaatgacaccgggtctctgatttgttcattctctttattgcctctgtggggaggattagagggctttgtaggctgggctgctgtgtgcgcacacaaatgtatgtgcacatgggcacacatctgtgctacactcatctgtctacacatctcatcagactctttaatctgtttttttgtttgtttgtttgtttgtttgtttttaacactgagtctcgcactgtcacccaggctggagtgcagtggcgcaatctcaactcacttcaacttccacctcctgggttccccgcgattctcctgcctcagcctcctgagtagctgagatgacaggcgtccaccacaacacctggctaatttttgtgttttttagtagagacggggtttcaccatgttggccacgctggtctcgaactcctgacctcaagtgatccacccacctcggcctccccaaagtgctgggattaccatacctagcctaatctgctttcttttgacaatgcaaatgttttctttacatgtcatggaatggcttaaatcaactaatgctgtatttagggctgtgtggtggatatgactctggagatccattctttgggtggcagatgtgggaaaagaggcttaggaaagaaccttgcttctaatggagccacagccagtcccctgctgtccccagcagcgaagccctgtgcagcaaggatgtccacacactacagggctctcatctcccgcttggtcaataatgaagtggcagtttcatctttttaggtttttgtaatctatatgtttttaaatgttggccaggagacactattctgaagagtgcagcctggaattcccatcaccgcctccgtttctaatcttctcaagcctcctggccactctcagcaggtaactagcatcttagtcaatgagaagacagagctgacctggtgcattcctcaacttctcttcttttggtttcatagtctcctggtccctttacctcagtttcccccctgctccttcccacaggcctgctgctcccgtctcctggcattcttcctcctgccccttctgcctcttctgggacctcaccaattgggaccccctcagtggtcttttcatgcttatgttttcagcctttcctcccaccaaagtcagggttacagaaggaagagaaggaggcagggagggagggaaaaggaaaggaaaggaaccacaatggcaccttgcctctgccacgctcctctccgatcgcctcctcaacaaagacgtcagattcccctctttgtaatgtcttctttgaatttcagcagtgtgggggatgttatgcttttgccttactccgccttatattttggctgtttgtgagctagtccaagccctattggactataggtgccttgagaaagagtgccacagtgccagggctgtgtctgctgcatgctgtttgtgagcttgtccaagccctattagactataggttccttgagacagagtgccaccgtcctggggctatgtccgcagcgtcagtatccaaggcctattagactataggttccttgagacagagtgccacagtgctggggctgtgtccgctgcgtcagtgtccaagccctattagactatagggtccttgagacagagtgccacagtgctggggctgtgtctgctgtgtgctgtttgtgagcttgtccaagccctattagactataggttccttgagacagagtgccacactcctggggctgtgtccactgcatcagtgtccaagccctattagactataggttccttgagacagagtgccacagtgctggggctgtgtctgctacgtgctgttggtgagcttgtccaagccctattaaactatgggttccttgagacagactgccacagtgctggtgctgtgtccgctgcatgctgttggtgagcttgtccaagccctattagactataggttccttgagacagagtgccacagtgctggggctgtgtctgctgcgtgctgttggtgagcttgtccaagccctattagactataggttccttgagacagagtgccacagtcctggggctgtgtccactgcatcagtgtccaagccctattagactataggttccttgagacagagtgccacagtgctggggctgtgtccactgcatcagtgtccaagccctattagactataggttccttgagacagagtgccacagtgctggggctgtgtctgctgcgtgctgttggtgagcttgtccaagccctattaaactatgggttccttgagacagactgccacagtgctggggctgtgtctgctgcgtgctgttggtgagcttgtccaagccctattagactatgggttccttgagacagagtgccacagtgctggggctgtgtccgctgcgtcagtgctcaggtctcctttgtccaaatgaaatgtgtgctgtggttttaaaaatgattctctgctctcgaactcctgacctcaggtgatccacccacctcggccagcctggccaacatggtgaaaccccctctttactaaaattacaaaaattagtcaggtgtggtggcaggtgcctataatcccagctacttgggaggctgaggcaggagaattgcttgaactcaggagtcagaggttacagggttgcagtgagccgagatggcgccactgcactccagcctgggcaatagagggaaactgtttcaaaaaaaaaaaaaaaaaaagaatctctgggctgggcgtggtggctcacactgtaatcccagcactttgggaggctgaggccggaggatcacttgaggtcaggagttcaagaccagcgtggccaacgtagtgaaacctcgtctctactaaaaatacaaaaattagccaggcatggtggcgggcgcctgtagtcccagctactcgggaggctgaggcaggagaatcacttgaacctgggaggcggagcttgcagtgagctgagatcacgccactgcactccagcctgggtgacagggcaagactccatctcaaaaacaaaaaatgaaaaataaaataaaaattaatctctgtgttatctagtagagctgtgattcgggaagagtaagaccacccaattacctttcacgtaagcagatggtattaggtcagagaagcctcacaacgcaacagagtcaggaggcagtcagctgactgggcaagtatgttagagggggaattatagaaaatgatgtattcataaaggtgttatctgaaattaaataatacaaatgtatttttattcattgatcttacgaaccacaaagggccaaggctctctctttgagttttcaattcaattaatttgacttccacgaaccacattcgtattaacagttcagtttttgctttgaatttcttcaaagagatttaagagcttaaaaaaacactttacaaccaactgggtatagactttttctagattcttacagtattttccactctataattcctcattcacacaaaattcaacatcgttaaaaaaaatttttttttttgagacagggtctcactctgtcacccaggctgaagtgcagtggcgctatcttggctcactgcaacctctgcctcccaggctcaagtgatcctcccacttcagcctcccacgtagctggggcaacaggtgcgcaccaccatgcctggctaatagtttatatttttttgtagagatggggtttcaccattttgcccaggctgctctcaaactcctgagctcaggcgatccacctgccttggcctcccaaagtgctgggattacaggtgtgagccatggtacccgtccaaaaaatcctcattttttatcacatcttttcaaagcattgagttgagtttttataaaaacattaactctctttacaaaatcatttcattggcttatacagtattttatgtttttatttaaaataacaaggggcagaaaccaatttaggaggaaacacagctgacctattaagaactatgcagctgattctttttggagcaaaagtgcacaaactagaccacagcctccactaaccacgagccctcagcgtgctgtgggcgtcaggcagaacttcttatgcaggtgacccagagcattgctgaacctggccaggtggtaaggcagtggctcccaaacttagctacacattagactcacctggagggcttttaaacgcatcccagagtgcgtgctgccctccagcccaattaaattagaaaggctgggagtgggaaccagacgtcaatatttcttgaaagattccagggtgattccaacgggcagcaaagtttgggaggaactacgacggtgcgggaaggcgagttaaaagagcttctgcatgctttctggttagcttcggattttcatcttagatttagcattaattttctatgagatcttgggtgatttatttaacttctatgagcctcagtttccttatatgtaaaatggggctaatttctgcattgtgggatattataggaattaagtgatattaggagaatttaggatttcctgctaccttccaggtgcttaataaagtgtggctcaggcgtaggagacgttattatattgtttcctgtgggtagaataaggcatgtgggtaatttggtttggtcaaagtctagacttaaaatattgcatattagaatataactaaaggattactcaaggcagactgagttgtgttcctttaaccctgcagtcttgacctcaaaatctggaaagtcagtgaggaacctgcttcttacctgctattaattatcacctattgtgttcatttgctgtgtaactacactttctccccagccgccggaagtgatggaaattcttgataatagcaagtggcctgtgctgactcaccttgtactatttcaagttaagcaccatgtgtgaaattcacaattctgtgcctacggcaactccaataggcacggagcagagagtagattttccattgtctaaatgtgactcttactttgagtcacgcaggtataattataggtattttatattatcatcctcagcacagtctaaactgtgccttttgttcttgtgttctgttttactacatgtacattatccattttattccattacatcaaatggactgttagagtcagaattggtctctgtctttgccctttaatctgtggtgcatgtggaatatctgagcttctcctgtctatataattaggctgcaaaacagatgatattttgctttaaaaataactatttccatagcacgctgctgtgacccaagcttgcagggtacaaaatagcataaaacagaagtgacacattatatcttccccttaaaggggttttactgggaatagttgaagagaaacaaaatataacatccttaatgtaaaaagttctttgccatagacgtgccagtagctggagagctggaattgcaatgctttctttaagtatttctcacctttttttctcagtactagatatggaatttgaggataggaaggggtggaggcagattagccttaggacagtggttgccgaatattttcatcctacagcatgagcagtgctgcatcagccttgtccttcgggctcttctgcagacgcgtggatgcctagatccctcccacgcaccccgagtgccacctgcaatggtccagacacacgcgggtcccacacgctctgctcgctttttgtaccaacacctttcaatcttgccccaaattacttggcctccacaacagctttgggaagtttccatctctgcctttgccattttccttctgtgcagagtagggaaaggcagagggaagagttgctgtcctggcagtaacaggaggcaggccaggtatgaggctgtaagctgggccgcctggaaagatagggatccagaggcctggaggagcagcattccgctgctgcctgggattgaggcggggggaagggagacagccaaggagtgggtgatgtacccagagacacgcctctctggaagagtggggcctggggcaaaaaggcggccttctccggctgcttcgtggagctgatggaggccgcaggatgtagttgagagctcaggtcttgcagtcagtctgtggtttgaatcctagctctactactggctgcaggatcgtgagcaagttttttttttttttttttttttttttgttgttttttaacaactttaatgagatatacctgagctacaataaactgtacatattaaatcatataacttgatgttttatcatatgtatatgcctatgaaaccgtcctcaatcaagataatgaatatattcttcacccccaaaagtttcctcgggagccttgcaatccctgcctccagctcctcttccttcctgtctccagacccaggaaccactgaactactttcagtttctagacattagtgtggatttcctagaattttatgtaaaaggaaacatatcttgcagacggtactctcgtgtgtggcttctttcacttagcataatgattttgagatgtaatcatttcattgcctgtatcaatagttcatatatttatatttctgcataatagtccactgcccagatataccacagttggccgatccattcatctcttgatggacatttctgttgtttccagtttggggatattacaaataaaagtactaaaggttgagcatccctaatctgaaaattcgaaatccgagatgctccaaatctgaaactttgtgagcgccaaatgacatcacaagtagaaaattctacatctgaccgcatgtgacaggtcacaggaaaaactttttgtgtacaaaattatcaaaaatattgtctaagattatcttcaggctgtgtatataaggtatatatgaaacataaatgaatttaatgtttacgttgggtcctatttccaagatatgtcattagatatatgcaaatactccaaaatctctggttccaagcatttcagataagggatattcagcttgtgtgagcatacatgcacaagtctttgtatggttatatggtttggctctgtcctcgcccaaatttcatgttgaattgtaattcccagtgttgggggagggacctggtgggaggtgattacatcatgaggatggatgtcccccatgctgttctcatcatagtgagttatgagatccggtggtttaagagtgtgtggtactctcccccctgctcactcgctctctctcctgctctgccatgggaagatgtgtcttccttcactgtgagtcaatgaaacctattttcctcataaattacccagtctcaggtagttatttatagcagtatgaaaacagtctaatatatatatggacatatattttctttcctttggggtaaaaacctatactagaactggaatcttatcaatgtctgggaatatttgaaaaaaaaaaaaagaaaaactggaatggctgtaccatatagtagatgtttaactttttaagaaatttctcagctgtttcccaaagtgcttgtactattttatatggggagttcccgttcctccatacccccaccagcatttggtgtggtcagtcttttaagttttgcctgtttacatagtaggtttgtaatagtgtcttgtggttttagtttgcacttcgctaatgaccaatgatgccaagcatccttctacacgcccattcggcatccatacctcttctttggtgaaatgtcccttcaaatcttctgtccttttaaaaattgttttgaaagtttttaatatattctggatgcaaatcctttataagatatagtatttgcaaatattttctctcagtctgtggcttctctcttcattctcaacagcatcttttgaaaaacaaatacttgtttttttatgaagtccaatttatatgttcttttatgaatcatgtttttgctgtcacatctaagaaatctttgcctaacccaaggccaaaaaggtttcttcttatgcctcctctagaagttttgtaattttaggcttcaaatttaggtctttgatcaatttttagttaatttttgtatattttgcaatgtatggactcaagtagtttttttcaggttgagggaggttaggtgtttttttgtgtgtgtgtatgaatatagtatccaaaatttccagtatcatttgttgtaaaaagctattatttctctactaaattacctttgtcaaggattagttggccatatttatgtgcaactatttctagactctgttctgttccattgatctatttgtctatctttacaccaataccacactgttttgattatggtggatgtataataggtcttgaaattaggtaatgttaaccttccaactttgttcttattttttaaagttgttttggctattcagtgtatttggcatttccatacaaattttagagtcgctttctaaatggattacgtagaaaaaatttctatcaaagaagtctaccaggattctgattgggattgcattgaagctatagcaacttggagatgattgacctcttcacagtattgagtgttctgacccaggagcacagtatctctctctagtttaggtttttattagttcccttcagtaattttttaaagtaggaaaaagctattatttaaacatgtatttcttttatattgatatataattacacatatttatgggtgatattttgatgcacgcatacaatgtgtgatgatcaatcagggaatttaggagattcatcacctcagttatcacttatttgtgttgggaacatttcattattttcttctagctatttgaaaatatacaataaattattgttaactatagcctcctactgtgctatcaaacactacggcttcctccttttatttaactgtgtatttgtaactgttaacccacctgttttatccccctcccccggcaccccacatcccgccccttcccacacacacacattcttcccagcctctggtatctaccattctcctctctacctgcatgagatcaactttttaagctcccacatatgagtgagaacatgcaatatttgtctttctgtgcctggcttatttgacttaacataatgacatccagttccatccattttgctacaaatgacaggatttgagtttttgtataactactagtattccattgtgtatatagagcacattttgctacaaatgacaggatttgagtttttgtataactgctagtattccattgtgtatacagagcacattttcttggtcccgttccattcatccatccattgttggacacttaggttgattctgtatcttggctgttgcgaatagagctgtgataaatataggggtacaggtatccctttgatatactgatttctgttcctttggacaaacacccagtagtgggattgctagatcatatggtagttctcgttttagtttttttttgagaagcatctatactgttttctatactggctgtactaatttacattcccaccaacagtgtgtaagagttccctttactatgcatcttcactagatttcatggtgggttttttttttctgtctttctaataatagccattctgactggggtgaaattatatctcattgtggttttgatttgcacatccctgatgattagggacattgaacattttttcacatacctggttgccatgtgtatgacttcttttgagaaatgtctattcagatcctttgcccaatttttaatgggtttgtttgggttttttgctgttttgagttccctggatattaattccttgttgaatgaacagcttgcaaatattttttttccattctgcaggttgtctctttgctctgttgattgtttccttagctgtgcagaacgtttttagtttaacatactccaatctttctaattttggttttcttacttgtgctttcaaagtcttagccataaaatctttgcctggaccaatgtcccaaagcatttcccctatgttttcatctggtagagttattgtttttggtcttaatatttaagcctttaataaattttgagtggatttttatatatggtaagagatagcggtctagtttcacccttctgcttatggatatctagttttcccagcaccatttattaaaggggatgtcctttccccaatgcatgttcttggtgcctttgtcaaaaatgagttggctgtaaatagatagatttatctgtaggttctctattgtgtcccattggtctatgtgtctttttacgtcaataccagcctgttttatgttacagtagcttcctagtagtgtattttgaagtcagctagtgtgatgcctccagcttgtttctttgttttccagtattgctttgtgtgcaaggtttttctctgtgtgtttaaattccatgaagaatgtcatggatatttcgacagagactgcattgagtctgtagattgctttgagtaggatggtcattttaacaatgttaacttgaactcaggattcagaaactcactcaaaaccacacaactacatggaaattgaacaacctgctcctgaatgagtcctgggtaaataacaaaattaagggagaaatcaatgagaacaaaaagacgatgtaccagaagctctgggacaccgctaaagcagtgttagagggaaatttatagcactaaacgcccacatcagagagctggaaagatctcagatcgacaccttaacatcacaattaaaagaactagagaagcaagagcaaacaaatccaaaagctagcagaagacaataaataagatcagagcagaactgaaggagttggagatgcgaaaaacccttcaaaatatcaatgaatccaggagccagttttttgaaaaaaaaaattaaggaaatagaccacttcactagactaataaagaagaaaaggagaagaatcaaacagacacaatagaaaatgataaaggggatatcacccctgatcccacagaaatacaaactaccatcagagaatactataaacacctctgtgcaaataaactagaaaatctagaagaaatggataaattcctggacacatacaccctcccaagactaaaccaggaagaagtcaaatccctgaatagaccaataacgagttctgaaattgaggcagtaattaatagcctaccaaccaaaaaaagtccaggaccagatggattcacagccgcattctaccagaggtacgacgaggagctagtaccattccttctgaaactattccaaacaatagaaaaagagggaatcctccctaactcattttatgaggccagcatcatcctgataccaaaacctggcagagacacaacaagaaaaaggaaacttggccgggcacggtggctcacagtggctcatgcccataaccccagcacttaggggagccaagcaggtggatcacttgaggtcaggagttcgagaccagcctgccaacatggcaaaaccctgtctctactaaaattacaaaaatagatgggcatggtggcgggtgcctgtaatcccagctaatcgggaggctgaggcaggagaatcacttgaacctgggaggcagagattgcagttagccaagatgaagtcagcttcatccctggttcaacatgcaaatcaataaacataatccatcacataaacagaaccaatgacaaaaaccacatgattatctcaatagatgcagaaaaggccttcaataaaattcaacacccttcatgcctcaataaactaggtattgatggaacgtttctcaaaataataagagctatttatgacaaacccatagccaatatcataatgggcaaaagctggaagcattccctttgaaaaccagcacaagacaaggatgccctctctcagcactcctattcaacatagtgttagaagttctggccagggcaatcagacaagaggaagaaataaagcatattcaaataggaagagaggaagtcaacttgtctctgtttgcagttgacctgattctatatttagaaaactatatcattggagcccaaaaacttcttgaactgataagcaacttcagcaaattctcaggatacaaaatcaatgcaaaaatcacaagcattcctatacaccaacaacagacaaacagagagccaaatcatgaatgaactcccattcaccatcgctacaaagagaataaaatacccaggaataccttacaaggaatgcgaaggaccccttcaaggagaactacaaacaactgctcaaggaaataagagaggacacaaacaaatggaaaaacatctcatcctcatggataggaagaatcaatatcgtgaaaatggccatactgccaaaataatttatagatccagtgctattcccatcaaactacactgacagtcttcacagaattagaaaaagctactttaaatttcatatgaaaccaaaaaagagcccatatagcaaagacaatcctaatcaaaaagaacaaagctgggaggcatcacgctacctgacttcaaactatactacaaggctacagtaaccaaaacaacatggtactggtaccaaaacagacatatagaccaatggaacagaacagagacctcagaaataacactacacatctacaacaatctgatcttcgacaaacctgacaaaaacaagcaatggagaaagaactccctatttaataaatggtactgggaaaagctagccgtatgcagaaaactaaaactggaccccttccttacaccttataaaaaaattaactcaagatggattaaagacttaaatgtaaaacccaaaaccataaaaaccctagaagaaaacctaggcactaccagccaggacataggcagaggcaaagacttcatgaagaaaacaccaaaagcaattgccaacaaaagccacaattgacaaatgggatctaattaagttaaagagctcctgcacagcaaaagaaactagcatcagagtgaacagacaacctacaaaacgggagaaagtttttgcaatctatccatctgacaagggtctaatatccagaatctacaaggaacctaaatttacaagaaaaacaaacatcaaaaagtgggcaaaggatatggagagacacttctcaaaagaagacatttatgtggccaacaaacatgaaagaaagctcaacatcactgatcattagagaaatgcaaatcaaaatgacaatgtgataccatctcatgccagtcagaatggtgattattaaaaagtcaagaaacaatagatggtggcaaggctgtggagaaatagaaacgctttcacattgttggtgggaatgtaaattagttcaacttctgtggaagacagtgtggtgattcttcaaggatctagaaccagaaataccatttgacccagcaatcccattactgggtatatacccaaaggaatataaatcattctactacaaagacacatgcacacatatatttattgcagcactatttacaatagcagagacatggaaccaacccaaatgtccatcaatgatagactgcatgaagaaaatgtaatacatatgcaccatggaatactatgcagccataaaaaagaatgagatcatgtcctttgcagggacatggatgaagctggaagccgtcatcctcagcaaactaacacaggaacagaaaaccaaacaccacacgttgtcactcataagcgggagttgaacaatgagaacacatggacacaaggaggggaacaacacacaccagggcctgtcagggggttgagggaaaggggagtgagagcattaggacaaatacctaatgcatgtggggcttaaaacctagatgacagtttgatgggtacagcaagccaccatagtacatggataactatataacaaaactgcaggttctgcacatgtatcccagaacttgaagtaaataaataaataaataaataatattaactcttctgatccatgagcatgggatgtcttttcatttttttctatgttcttcaatttttttatcagtattttgaagtttttgttatagaggtatttcacctccttacatttattcctaggtattttttagtagctacagtagatggggtagctttcttggtttctttttcaactatttgttgctggtgtgtagaaacactactgatttttgtatccagccacattaccaaatttatcagttctcagagtttttggtggaatctttaggttgttctaattattatatgccatctgcagagaggaacaatttgactttcgcttttccagtttggatgccttttatttctttctcttgcctaattgctctagctaggacttccagtactatgttgaataacagtggtggaagtgggcatccttgtcttgttccagttcttagaaaaaaaaggcttttagcttttccccacttattatgatgttagctgtgggtttgtcatatatgacctttgctatgctgaggcatgttttttctatgcctaacttattgagagtttttatcatgaaggatgttagattttatcaaatatttttcctgtgtctattgagatgatcttgttgttttagtctctcatatgttgatgtgatgtgcacgtttattgatttgcatacatcgaaccatcattgcatccctaggataaatcccacttgattatggtgtattatgttattggtgtgttgttagatttggttcgctagtattttttagatgatttttgcatctatgttcatcagggatattggtatctcattttggtattaggataatggtggcctggttgcgtgaattaggaagacttcccgcctcttcaatttttggaatagtttgagaagaattggttttactttactccttaattctactgaacttttaaagtcctgggcttttctttgttggggaactttttattactgattaattcttgttactcattatttgttcagatttttttattcttcctgatttaatcttgtaaggctgtatgtgtccaagagtttatccatttcacctgagctttccaatttgttcgtgtgtagttcttcataagactctaatcatttgtatttctgtggtatttttttcatttctcattttttaaaatttggatcttttttcttggttagtctaacagtttaatcaattttggttcctttcaaaaatcaagcttttattttcttgatcctttgtaatttttgtgtgtgtgtgtgtttatttcgtctctgatctttattctttcttctgatttttggctcagtttgctttggcttttttagttccttgagatgcatcattcggttgtctatttgaaatctttctccttttttgaggaaaacatttattactctaaacccctcttactactgcttttgttgtatcccgtaggtttaggaatggtgtttttccattttcatttgttttaagaaaaaagattttatttcattcatttaggagcatgttttcatgtaggagcatggttttaaattttcatttatttgtacagtttctaaagttcttgttattgatttcgttttactgaattgtgatctaagatgcttgatatgatttcaacttttaaaaatgtgttgagagttattttgtggtctaacacatggtctatcatggagaatattccatgtactgataataaggttgtgtattttgcagcacttgaatgaaatgctctctaaatatctgttcgatccatttggtctgtagtgcggattaagttcaatgtttctttattgattttctgtctagttgatctgtccagtgctaaagcggagtggtggaccaggaccaggcacattggctcacacctgtaatcccagcactttggaaggccaaggcgggccaatcacttgagctcaggagtttgagaccagcctgggcaacatggtgaaactctgtctctagaaaaaatacaaaaactagctgggtgtggtggcatgcacctgtagtgccagctactccggaggccaaggtggaaggatcgtttgagcctgggagattgaggctgcagtgagccaagatcacaccactgctctccagcctgggtgacagagtgagaccccataccaaaaaataataaataataaaatggagtggtggaggcctcaactattactgcattggggtcaagctctttagctctaatgataattgttttatataatatatctgggtactccagtgttgactgcatatatatttacaattgttatagtctcctgctgaattgttccctttatcattatattaatataatgaccttatttgtcactttttatgttttttggctaacattgtattttgtcttatgtaagtatagctactctggcacacttttggtttctattttcatggaataattttttccatcccttcattttcattctatgtgcatctttacaaatgaaatgcatttgttggagacagcatacagttgggtcttttttttttttttaaataaatccattcatcttgtctatattttttacttaaggaatttaaactgtttacattcaaggatgtcattgataggtaaggacttacttctgtgattttgtaaactgttttatgatggttttgtatattttttgttcctttcttcctcttgtattgcttaccttgatgatttggtagtttattgtagtgatgtttgactcctttctctttctcattcgtgtatctgctctcccagtgagtttttcagtcttgcgtattctcacggtggtagttattgtccttttgcttccagatgtagaactccctcaagcatttctcacagggcctgtctagtggtggtgaattccctccattttttcttgtttgggaaagactttacttttcattcattttttaaggatagctttcagcaatatttcatctttttttaaggatagctttcagcaatattttatggtttttatgtacacattttaatcatatctctaaatcatgtgtttgatgttgttgtaaatggtatttttaattttttttgagttggggtgacagagtgacacccaggctggattgtagaggcacagtcatagctcactgcagcctcaaatttgtagtgttcctgccacctcagcctcctgagtagctaggattataggcacatgacatcatacccagctaatttctttttgtatcatttttctgtagagatggggtctcactatgttgaccaggctggtcttgaactcctggccttaagtgatccttctgccttggcctcccaaaatgctgggattaccggtgcgaggcaccacacccagccttatgttttaatttctaattgtttgttactatgataaagaaatgcattgatttttgtccattgacctcatatcctgcaaccttcctaaactcacctattagttctagtaccttttttgtggattgcatccattagatttttctataggtgactatatcaccaatgaagatcatttgactttctttccaatctggatatcgttcatttattgtacttgccttattgtactggccaggacttccagtataatgttaaatggaaacggtgagagtggacatgcttgtcttgctcccaatcttagagggaaggcatttagtcttttaccattaagtatgatgttagctttagtttttagtagataccttttattaaattgaggatattgccttctacttatatattgctgaggattttttatcaggaatgactgaattttggtaaatgctttttctgcatctactgaaacaatcatatagttttcctttcagtttgttaatatggtaaattatattgattaggttttttttgttaatcaaccttgcattcctgaaataaacctcacttgctcatggtataaaaccctttgtatttgttgctagatacaatatttttttgagttggggtctcactctgtcacccaggctggagtgtagtggcatgatcacagctcactgcaattttaaactcctgtgctccagcaatccttccttccatctcagcctcccaactagctaggattacagtgtgcaccactgtgcccagctaattttttatactttttttgtagtgatgaggtcttgctatgttgccctggctggtcttgaacttcgggcctgaagcacctcagcctcccataatactgagattgtaggagtaagccaccatgcctagccctagatacaattttctaatatggctctttaatattttatttagaatttttttggcaatgttcatgagggatattgttctgcaggtttttgtgtttttttttttttttcaaacaacatacttgtttgcttttggtatcagattagtatagtatagcttgggaagtatttcttcctattttcaggaagactttgagtagaactgttattatttcttccttaaatggtgggtagaattcaccagtgcctccatctggtcctagagttttacctgtggaaaggttgtgaactacagattctatttctttaatgaatctagggccatttttattatctattacctcttgaaagagctttggaatttttcatctttcaagacatttttccattcttacacattgtttaatttactggcataatgtttctttattatctttttgatatctgtaggaactttagatgaggccatctcattcctgatattgatcatttgtgtctttctttttcccagatcatttgtgctagggatttacaaattttgttgatcttctcaaagaaccaacttttgattcatcgacttttctccattgtttttggttttctgtttcgttgatttctgctattttttttcctttctgctatttttttttcctttctgctattattttgtctataatttgctcatctttttctaatttcttaaggtgtaagctgagatcattgatttgaagccatggttgctttctgatataggcatttaatgctatacgtttgttttaagtacatcttcagggttattcacaaatttggatgggttgcattttcatttctattcacttaaaaagactttaaaattttcattttgaatttttccttgaccataggctgtttggggccaagttgtggagtttcagaatatttggaggtttttcagatattgttctacattgacttctaatttaattccattgtatcaggcaacatgctttgagtgacatgaatccttaacatttatttagacttgttctgtggaccagaatactgtgtatcttggtaaatgctttgtgtgcacttcaaaagaatgtgtattctgctattgttgggttgaatgttctgtgtcaagtagatatttgatagtattgttcaaatttatatccttatggttttctgtctacttgtcatatcagttttgagatgggggtatttgaaattgccaactataattaaagacttgtctgtttcttcatgcagttctaccagattgttcttcatggattagaacatgagccacataaatttttttattatgacctcttgatgaattatctcatttctcattatagaacgtttttttttttgactctaacaacatttttcatcttcagtcttttttggcatttttaaattgtgtgtcatagttgtacatatttttggagtacacatgatattttgatgcatgtatacaatgtgtagtgatcaaattaggaaaattgggatattcatcacctcaaacatttatctttgctttgtgttgggaatgtttattattaactatagttcttctactgtactattgaatactaaaactcattccttttatctaactgtatgtttgtacctgctaaccaatttctctttatcctaccctctgcccttcccttcccagcctctggtagccactcttctactctctatctccatgagatccactgttgtagctcccacatatgagtgacaacatgggatatttgtctttccatacctgacttatttcatttaacataatgacttccagcttcatccatgttgcttaaaatgacaggatttcattatttttatggctgaataatattccattgtgtgtgtgtgtgtgtgtgtgtatctatctcacattttctttattaatttacccattgatggacacttagactgattctatattttggctattgtgaatagtgctacaataaacatggtagtgcagatacctctttgatatactgatttcttttactttggatatatactcagcagtgggattgctggatcatacagtagttctacttttaagttttttgagaaacctccagaatgttttccatgatggctgtactaatttacattcccaccaagtgtatgagcattcaccatttcctgcatcctctccagcatttgttttttgtctttttgataatagccattgtaactgaggtgagatgatagctcgttatggttttgatttgcactttcctgatgattagtgatgttgaacatcttttcacatacctcttggccacttgtgtgtcttcttctgataaatgtctattcaggtcttttgctcattttaaattggattatctggggggttttggcccattgagttgtttgaattcctcatatattctggttattaatcccttgtcaaataatttgcaaatattttctcccattccatatgtaggttatcttttcactttgttgtttcctgttctgtgtagaagctttttagcttgatgtaatcccacttgtctatttttgcttttattgcctatgtttttgaggtcttaccccaaaaatattcgccaatgtcctgtagtatctccccagtgttttctcccagcagtttcatagtttcaggtttaaatttaagtccattttgagttgattttcataatgtgataaaaaatgaagctctagtttcattcttctgcatatgaatatccagttttcccagcaccatttattaaagagattgtcttttccccaatgtatgttattggtgcctttgtcaaaaatgagttggctgtaagtgcatagatttatttctgggttttctattgtattccattggtcttctatgtgtctgtttttatgccagtggtatactctttgcttactatagcttgtagtataatttgaaatcagatagtatgatgtttccagcctggttatttttggtcagtattgatttatctactacgggttttttgtgattctataagaattttaagatttcttttttctatttctgtgaagaatgtcatgagtattttgatagggattgcagtgaatctgtagattgctttgggtagtatagacattttaataatattaattcttctttgagcatgggatatttttccatttatgtgctcttcaatatctttcattggtgttttataatttttcttgtagagatctttcacttctttggttgaatttttactaggtatgtttttgtagctgttgtgattgctttcttgatttcctttcagattgatcacagatagcatatagaaatgttacacattttgcgtgtttattttatatcctgcaactttattaaactcatttatcagttctaaaagttttttggtggaatctttagatttttctaaatataagatcatgtcatctacaaacaagaataatttgacttcttcctttctaatttggatgccctttatttctttctcttgccctattgtgctggctaggaattctagtactatactgaataattacagtttatagttcaccactgagcatccttttcttattccagatcttagtgaaaggttttctattttaacctattcagtatgacataagctgtgagtgtgtaatatatgacacttatcttgttgaggtatgttccttctataaatttgttgaggattttcatcacgaagggatattgaattttactgactacctttccagcatctattgaagtaattcatatattttccttgattctgttgatgtgtgatgtattaaacttatttgacttacatatgttgaactatccttgcatcactgggatgaatcctacttgattatggtgaatggtctttttaatatattgctgtcttctgtttattggtattttgttgaggatttttccctctttttatcagaaatattgtcctgtagttttcttttgttatctttggctttggaaataaggtcagggtggccttgtagaatgagtttggaagtatttcctcctcttcaattgttaaaaatagtttgagtagaattggtattagttattctttaaatgtttggtagatttcagcagtaaatccatcagttccctggcttctctttgatgggagactttttattactgttccaatctattacttgttattggcctattcaggtttttatttcttcacagttgagttttggtaggttatatgtttccaggaatttttccattttttcctagattttccaatttattggcatatagttattcataatggtcgctaatgatcctttgtgtatctgtagtatcagttgtaatgtcatctttttcatctctgattttatttagttgggtcttctgttttttcttagtctaactgaaggttttaaaattttgttgcttttcaaaaaaacaaactttttattttgttggggttttttgtattgttattttagtctcaatttcatttatttctgctccatctttactcatttttttcctactaattttaggtttggtttgtttttccttttctagttcattgaggtgcaacattaggttgtttatatttggagtctatatttttaatgtaggtatttattgctatagaactttccattagtgctactttttctgtatcccgtgggttctggcatattgtatttccattttcatttgtttcaagaactttttaaacttcattcttaatttcttcattgacccattgatcatccaggagcatgttattcaatttccatatatttgaatagtttccaacatttcttgttatttatagttttattctgttgtggttagaaaagatacttgatatgattttgactttttaaaacttgttgagacatgttttgtggcctatcatatggtctgtcctggagaatgttccatgtactgatgagaagaatgtgtattttgtagcagttggatcaaatgttctgtgaatatctgttaggtccctttggtctagagtatagtttaattctgaggtttctttgttgatttttctgcctgaatgatccacctattgccaaaagtgaggtgttgaagtcccttactgttattgtattgtagtctacctctcctgtttagatctactaatatttgctctctctctctctctctctctatatatatatatatataccctgctatttggttatatatattcataattgttatatcctctttcagaattgactccttgctgaattattatataacaatttcctttgtttctttatatagtttttcacttaaagtctattttatctgatcgaagtatagctagtcttgatcatttttggtttccatttgtatggaatgcttttggtttccatttgcatggaatgcttttcccatcccttcactgttagtctatgtgtgtctctataggtgaagttagtttattgtaggcaacatatacttgggtcttacttattaatccattcagccactccatgtcttttatttggagaatttagtccatatacattccatgttattattgataggtaaggccttcctactgccattttattacttattttctagttgttatatagtgtacctccttacttcctttcttatttttgtggttaagtgattttctttgatagcatgttttaatttgctgcttttattttttgtttatcaattatagatttttgctttaggttaccatgaagcttacaaaaacatcctgtaattataacaagttatttaaaagtgataccaatttaacttttcattgtagcagaagaaaagaaacaaaaagaaaaaaacacatgcattttaattcccttctgttcctacattttaaatttttgatgtcacaagatcaaaatttgcctacctcaaaaattttatagttgttatttttaatagttttgtcttttaatcttcttaataaaattttaaatggtttagatgccatgattacaatataacaatcacattagcattatttttcctatgcttttaagaacttctttagcatttatcataggctaggtctggtagtgatacgttttctctggaaaactcatctctccttcatttctgaggaataactgcttggtgcagtatccttggggaacattttttttttccttcagcactttgaataatatcatctcactccctcctgacctgtaaaatttctgctgagaagtctgctgccaggtgtatttgatgtccgttgtatgttatttgcttttttcttgctctctcactgtttttaggaccctctttgcctttgacctttgtgagtttaattataatatgtcttggggtcttctcacttgggttgaatctgatcggtgacttttgacctttgtgtacctgaatatttatatttttctccaggtttggaaagttctgtgttatttctttgaataagcttgcaacttcttgtctttctcagttctctctttaattccactaacccaaatatttgctcttttgatgttggtccataggtcccataagctttgttcattccttcttattcttttttttctcttctgactgtctattttcaaatagtcttgtctttgagctcactgatcctttcttctttttgatcaattcctctgatacgctctattgcatttttcatttcatttattgaattttttacctccaggatttctgtttaattttattttttaaatcttttctgtgaactttctctgagagatttctgtgagctttcttgaagttcactgagcttccttaaaactgctattttgaattatttgtctgagagatcacatattttcatcactttagggccagtcttggtgccttactttgtccctttgacatcatatttccctgaatgttcttgacgcttgaagtatgatgatatctacacattgagagattaaatattttagtcttcctagtctggctttgtttgtgcctgtacttcttcagagggtcttccagagattctaagccaactgactattgtgttccctgtgatcaccacagtaatctcagcattagaggatactctattccctggcttgctgtgagtctcacaatggctttctggcccaaacggacctggggaagacccaatgacggtacttgtgttatgtgggaacactggccaccagggacctgagtcctgaagactgtcctagtttcccagacaagtctacttcccagcaggtctctgcacaggtaggttgtgtccccaactatagcaagaggggcagaagttgagactggaccccttcagaatctgctgtgggaaggaggctgatgggcctttctcattggctgagacaggcatgtgttactcagcaagtctctgcacaagtggagtagtttcttgcccataacaggaggagctaaagccaagactgggcctcctcagggtctgctataagatggagggtggccgggtgcctgtagtcctagctactcgggaggctgaggcaggagaatggcatgaacccaggaggcagagttttcagtgagccgtgattgcaacactgcactccagcctgggggacagagcgagactccgtctcagaaaaaaaaaaaaaaaaaaaaaaaaaaatggaggctggcatacctgccacattggctcaaatgggcatgcatcttctagtaagtccctgcatagacaggatagttccccaactatcagcaggaggagctggagcagaatctgggccctcataagatctgctgtgagacagatactgaaggggtcagtctcagctcagaggggtgtgtgtcacccagcaagttcctgtagagatagaatagttatctgattacagagagagggtctggagctgtgactgggccctcttgggatctgctgtggaatagaagctggagagcccagtcttgtatcagaaggcatgtctttcccaggaggacactgcatcaataggatagttccacgactgcagcaggaggtgctgtacatgcctctctgcgggtcttagcacaaatgggataggtctttgactgtcttcagtctcttttgtctaatattggtagatccactccagctcttatggttactgtttgccttatccacacttacacgtttaaatgattgtttatttctatttgaagtgtatttctcaagcatatagtagagcctcacttttttatccaatctgacgatttttgccttttaataagggtattttagactatttcaatttcatatgattattgatatggtttggttcaaaatattattttctgttttctatttgtcccatctgatctttgttctctctctctcttttttgctttcttttggatttatgaaacatttaaatggttccaatttccatcttctgtgggtttattagctattacttttattgtttaattattgctttagtgtttgtaatatatatgtttaagttaccacagtctaatttaaagtgatattataccacttatataaggaataaaaaccttacaatagtatacttccatttctcccgtctgacttttgtgttattgctatcaaacattttaattttacatatgtcatcattcacacgttacattatgatttttgttttaataataatcttttaaagagatttaaagtaataaaaattacatatttacccatgtggttatcatttccaaagctcttcattcctttgtctatattccttgtgtttttgcttatggtgaattcttttaggatttttaagtcaaaaaatatctttatttcccttttgttttggaatgatacttttgctgggtgtatatttctaacttgacagtttttagtactttaaaaacattgctccactgtcttctcacctgtatttccaatgagaaatctgccgtcatccttatctttgttcctttatatgtaacgtgcttttttctctctggctcttttcaagatttttctttatatcactggttttgggcggtttggttatgatgtgccttgatatagtttcttcctttgtgcttggggctcacttagcttcttggatacatgggtttatgactttcattaaatgtggggaagttttagccattatttttctcaaatattttatttgtaccacactctgtcttctcctttagggactccaattacacatagcaggcacttgaagttgtcctacagctcttttttttctgtgttttatttgttgttttttttccctatatattttattctgaatagttttattgctagatcttcaaatttgctgatttttcattctgcaatatctaatctgccattcatctcatctactatattttttttatctcacacattgtagtttttatctctagaggttcagttttgtgtctttttaaatatatattccatgtttctacttaactttttgaacatctgaaatacagttgaaataactgttttaataaatagctgcttctgtcaattctaacatctatgctagttctaggttggtttcagttatctcttcattatgggtttcattttcccgagtctttactttgtaaatattcttaagctttgttttagaatgcagttgcattacttggaaacagtttgatcatttttttgttttgcttttaatatgtgttaggtgggatcaggtcagtgttcagtctgtggctaagtatgggaaagacttctgggtattcaacccaatgccctgtgaattgtgaagttttccaggctggctgttaggaagtggcactattcctggctttgtgtgagtgctgtgcaccattatctccaatctttttaggtagttaatttctgagccttgaatagttttctcacatgaatgttgtgttagtcccttttgcattgctgtaaaagacacctgaggctgggtgatttataaagaggcttattctgctcacagttctgcaagctatacaagaagcatggcacccagcatctgcttctggtgaggactcaggaagcttacgatgatggtggaaggtgaaaggagagtaggcgtgtcacatggcaagagagagcaggagagagaagggggaaggtgccagcatcttttaaacaactagcttttgcatgaagttaaagagcaagaactcactcattaccatgggaagggcactaagctgttcatgagggatccacccccaagacccaaacacctcccaccaggccccatctccaacactgaagatcacacttcaacacgacgcctgtgattctcagtgttggaacctgctgggaggtgtttgggtcatgggggtggacgacacatctccaacattgaggatcacatttcaacatgagatttggaggacacaaacatccaaactacatcaggtgtgctgatcagtactcagctgaacacttgagggaccttctgcaaatctctagagctctctcctctgcagtactctgtcttgtaaattgttgccaccttggtctccctgtacttcagcagcagaggtattcatgggcaagttgcttaagttttctgaacagttattttctcatcaatacagaaaggataatagtatttagcttatgattctactgtgggaactgaacgaaactgatgtttgtacagcacctggcacttggcagatactcagcaaatatttgggtcttccctgtctctgcacctggtcgttacttcttcctgatttttgtcttgggtttgcaacctgattcctggctgagctttaggttggtttctgtataacgatcaaccaaagcaggtaatcactcatgagccattcaggttttaacttgatgagtttcagaattctgctattcaaatggcatttaggtagaaacgtatcctcctgtaatttgacatttattttctccaaaatctcattcagttcaacctgcaagaattatttgaattcacttatttgtagtgtgaatgtcagtaggctttagaaggtcagtggtgcgtggtggaaagaatttaagaggaccaatgctatttgcaaccccagcgtgatttttctggggtttcctagtaggtcatgaacgtcaaccttttacttccccttctcattttgcctcagatttcccaaggagctacatgaagaacagatgagtgtttgtcagaacttaaccatttctcttttatcttctcccctgtggtagtgtctggaggtcgcagccgcctgcatctcattgatctcggcagctgtgtgaaagctcttagcaaaaatcgagaaggaggctcagggctgtgtctctcgctgtctgctctgggcaatgtcatcctggctctcgtcaatggcagcaaacacattccatacaagtaagtgactcttctactcaaagaatgtggtggggtaagcatggtgtgggacgctttgttcagtgccatctgtggagaggtgtgccacagagggacagcctggaccccattataagttcagtgccagagaccagccttagctaacagttgtgtaatgcatgatctcccaaattcaaaacttttggaaatacttaaatctattccagttctaactttaggctgctcaaattagaggaaataggaaattatctcagttgaggtctccactcgcaaatgaaggtggtgggtcattgtcaccataataaagatgtgcctgtttcatagtgatgagagtgaggggtggaagactggcttatccttaggggtagggccaccagacttaaccaaaaaaatataggatatccaggcaaattcaaatttcagataaccaacaaataaggttgtattataagtatgcaccccaacattgcatgggacgctcctggtgacatgtattttatctggcaacccaatctcgggagttcagaaagctaggggagttagcacctgccttcccatgcaaatgtttagtcacttccaggatccttcctgtctctttactactgctccaattaaattacagccgctcctatgtctggcagagacaaagccactccaccaccatcaccccaactaagcgttctcattggaccgtgtggtggcaggccattgactggctgtccaggcttctgccaaggcctagctgagcctcttactagctgcatgaaccttcattcttcctaaaatgagggttaaagctatacatgttacatcacagaaatataaggctcaaaatgataaaacatgtataaaagtttattgtaggctgggtgcggtggctcatgcctgtaatcctggcactttgggaggccgaggcgggtggatcacaaggtcaggagattgagaccatcctggctaacacggtgaaaccccatctctactaaaaatacaaaaaattagctgggcgtggtggtgggcacctgtagtcccagctactcaggaggctgaggcaggagaatggcatgaaaccaggaggcggagcttgcagtgagccaagatcacgccactgcactccagcctgggcaacagagcgagactccttctcaaaaaaaaaaaaaaaaaaagaaaaaaaagaaaatttattgtagaatttaggacactatggccaataaccaatgatgaaagtctggttacacctatctagtcaagcctatcctcacctatttaaagggaaaaaacaccgaccttacagagttgccatgaggtgaagattaactaaatatatgtggattcatggttttatctgtaaaaaccctacaaaacctacgttgctgttgtgtaggaggaaaaagtcgggcagtgtattctataattactgagattcacaatgagtgctggagtttttcttcccctcagccctatgttgatgccagacccccccaccaaatacattgtgagtttatttcctaccaggagaaccattactggactgactttaggagcttaaatggtgattataatcctgtccatctcatttctagaaatttggaatcctagttggataaacccagaaatggttttcccggctcttgtaacaacccttttctatgggagaatattctgagttgaagaattatagagtttcattcgatgtcatttctgtagttgagtaaattcagcttgtggggagaaagggcaggggagggaaaccgttggagttggagatgaagggaagagtactagcactcactggtttccataaaatgagaatcatgtctgttaatgtcagaacttcatagatcatgatatagataaaattccaaattgcaccttagcaggaggtcattgattacatatcttacttatagcttttacactgtttctgcagggcgacatgcttttatgatttctataaatagttgttgaattgatggcgggaagatagatgcatgtaaacatgaaattatttttaatttaaagtaacttccttttagttagagttgggttttttataaatgagtagggaaacattaaaaattgtttttatggcccagcgtggtggctcacacctatattcctggcactttgggaggctgaggcgggaggattgcttgagaccagcctgggcagcatggcaaaaacctgtctctacaaaaaatacaaaaattaaccgggcatggtgttgcatggttgtagtcccagctacttgggaggctgaggtggaagggtggcttgagtccaggaggcagaggctgcagtgagttgagattgcgctactgcaccagcctgggcaacagagtgagaccctgtctcaaaaaaaaaaaaataaatgaaagtttgtattaatcgttcaagcttcgtgttaattaagcatatttttaacatgctggccctaccaactggctacctgccctcctgggagacatctccactcaccagtccctgcagacagctgcctgccttcattccaggagtccccttccttctattctggcaccaagagagtgatcattaaagtgtttctgtgtctcaagtaagcagactagcttccatgcagtgtcagcacaagacccaatcctggagctgtcccgtggcctggttgagctgttgatggcgtgggtacagactcaccagctgcccttgccctgccctgcctaacacaactcatcgagaccttgctgggttgcctggtgctggaaacacggtggccctggccatccagccagcgctgtccttcccaaaacatccattggccagtgcgtttgttctgtcacccctcagtgtcctaatgcccttcattgtacgtgatcttaaaaagacccttgccgaaatgttttctccgagtctggaccacggcctagattcaatatttggcatctgcaaatgtacatttacaaagtgattcatcaactagaaactgtcctcttttgaggtacaggaagataaggcaaaggtttactcaaatcacccagccagtgggtggcaggatcaaactgcctcgctcctcacagcttcagaggcctcgacagttcccagcctcactgcagacccacgcccacttctcatcaagctcccgaaatgtcggagctgccttcactgcgcacggcaggggagcccagcacagcaggaaagccccgatttctttgatcaattccgtcagtgctctgaagccacattatgcagcattttgttagcatactaaacaccttcagggtgtcaagccttgtctttgcagtgcgttccttagagaagtggaagtttcctgcccttgaggtttcctcttactcctcctgctcacttacggagggtggcggggggaacaaaaatagaaaaccaaattccatattctctttccttcccccaccccccccaaaaaacacagacaccccactacctcttcatttgtctccccagacaactctgtacttggaacctgcattacttgtgcttgctcctgggaaattcgctgcaatgtgcacagaggggctgtagcctgtcttcattcctcttcatcatcttaccaggctatttgtcatgtgagcaagctggaaagtgagtttggattcattacccatcccaggcattcccacaggcaccctccatgtgcgctgaatgcttctgactttgcaaatgatattgcccttgaagatgcaggaggcgtggagcaggtttccaacctcagccattacacagcacaggcacattacatggcacaggcttgccggccagtccaggcgccataaatcagttctcaacggtggcaccattcagaaaagcatgcagggaaggcagggagaccaccaagggctccaacccctcgtcagttctgcactgacaggctgcacaaattactctctaatttttgagagcctccacctccagggaaccctgccctcattcgatcattttgacagtgcatttgcaaattttctttattcggtacattcatttgctgttccttactgctcttgggcaccaaggtgctaggaatcttcccatttaatggataagaaaaaataggcagaagcgttgaaatgacttctcaggccaaaacccagtgttgcacatcccacaggagttggcccccagaagaaccgccacaaggatctgtcagggtgaactgagcttcggctaacgggtgttatgtcccagctcatctgaaggaccacagcttttcgagactcagattctcaccatgacccaattatctcaaaatagaatttctggttctcttagatgttgctttgtagagggcacaggcccttagaaagcacacacctgtcatgcaggcgtccttcaagccctgaagcatttaccttcattgatgactgctgctccatatggagaaagaattcctttaatgggtcatatgacctgtttgcttatttgccaacacagtgtttctaaacactctgtttctaaacaacagctagttgctaatgtcttggctgccctttaacaagagttcatggaaagtccttctgtggccctctcatgtcatgcctgtctgagatgcttctcccagtcatcttgaaaaatggtgctacataaccatcctgtcgtggaaatgatgcccggcacctccctctcacgggtttggtctatggttcagacccagacctaatccttgtttgttgagatcagtcactgagacactttgggtctcagcagctgtgctgagctcgcctcctcctctctctggtagagcctgaggcaatctgtgatccaagctgcaggccacgagcaaacaccgcaggcaacatccacttccagaaggctgtgttccacaaaagcgatgaggacacccatcctcaggggctataatgggaactcttttcctcctaaggccctagtgaggagtcaggaaccaaggtcatctttaagcttgtagcatcgggacacaccagttcattcaaagcagcaggcagcactagaagctcaagttcaaatcagtgacttgaaaggaaatgacacttcataagtagaggcagctttttcaaaatgcaagcaccttctcatccaagagagggtggggttctggcacctgtgggtcacacttgtggcagcaggcccagcattggcaggaacttcaggacgagcctctgaaggatgtggacattcccctccttgcctggagaagtgcttcctcctagagcccatggagatttgggattagcctctcctttctcagaactggaaacccagtactcaaggtctgggaagctggggaaaggggctcaagattgctgttagctagagcggggttccaaacccccaggccacagattggtacaggtccctggcttgttgggaaccagcctgcacagcaggaggtgagcagtgggggagcatgaccacctgagggctgttggctgtctgatcagtggtggcactggattctcataggaacctcatgctattgtgaactgtgtgtgcgagggatctagcctgtgcgctccttatgagaatctaatgcctgatgatctgaggtggagcagtctcatccccaaaccattccctactcccattgggtccatggagaaattgtcttccacgaaacctgtccctggtgccaaaaaggtaaaagggtttgggactgcggagccatggcattgaattcccatctcacacaggagaggaaaggctcttcctcaggacttggatgtatattacttagacgtaccatgaaattaagtagatatttgccaggaaaaatgcaaaggagtatcagttctccagatttgtttaagatagcatgaaacggagaggttcatgtaagaatctgtgtgtgtgtgtgtgtgtgtgtgtgtgtgtgtgtgtgtgtgtgagagagacatatgcatatttaacctcctttaaatgtacattaatgctgtattttctccccctgatttacagggagaatatcaatttagaactatttgcacaaactctagataccagtttagagcgttccctatttagaaataaaataaccaaagtctcaggttgccaggcaactgcagcaatgataattcttagtattgctgctttagaaatactcatttttatacattttagtgatggttaggatgcagagaatgtgagttcagaatgtcgctgggacatcgaagtcccttttctatgagatttttagcattctcacttgcttttatttttcccccttagctctgtttgcttccttggctagcggtatcttcatatttagctatagaaatctcgagagattgttattattttcttaagagttgaggcagaagctgccactacattaattctgccaggctcattatagaaccacgccagtcactcagggagaaatgacaccgtctggggatcggccggggtcacaaacactgggttcaagctttggttgttctgccgctagtttgacacatgaactctacacctcgtccttttcattcttaagaggaccacattctggcccctctcagagcttcactgaattgggaacagaatatcaggccccagctctgtcatcatctcttggcggcaaagccacggctcatgtttttgtctgtccactgcagcagccgttgtggcgtaatggcacatgatggtctcggggctgggtagaaattggaaggcgtcttcctttcccttttggcctttcaagtgtatcttcctttatgtctaatgtctggggttactattaaagtctttctgaattctgaaccaatgatcagatagatacaagagaatgattgggaatgaaaagcctgctaatcctagcagagtaggaaagggtagacagccccttccccaaccccacggcctcagtggaggagagaatggtgtggcctgcaggggagggacaggcagacagcgccagctgtcacccaggctcacgttcaccagcctcagcagtcagaccttcttccttcctcccttggaggaagtgaatagaagggcagaaccgagagcgggaactctatcttgatcttgctaaaggggtagaagttcctaattcgtggacttgctggaccacagggaggaggagaaaatgatttctagtacttatttcctggcatttcagctacatggaaggtagttagcacggtgcataaatgagcccccggtgagagtatttcccatcgtgagcaccacagccgggcgttgttctcactgtgcctcacaagctctgctaaatgccttatggatatttcattctgacaacctgtgacataggtactgtaatcatactagtatcacagatggggaaactgagacacagaaaggttgagtatcttgtccaagttcacacagctaataggcaacagggcctcactgcctcccagtttatcaccccccaccgagtacagtttctggaatattgtgctcggtcaacatttgttgcaataacaagtggggtacaacagaggatcaaacataccagcaaagcttgcatatgtgtagttgattataagtaaaagcacagtctgggcacagtggttcacacctataatctcagcactttggaaggcctaggcaggaggatcacttgagcccaggagtttgagaccagtctgaacaacataaggagacctcgtctccacaaaaaaaaattaaaacactagctgggcatggtggctcatacctgtagtccaagctacttgggaggctgaggtggaaggatcgcttgaacccaggaggttgaggctgcagtaagctatgatcgtatcactgcactccagcctggacaacagagcaagaccctgcctctaagtgagtgaatgaatgaaggcacagacccgaggggcagggctgatggtagccaattcatacattcaggtcggtctcctggtctcacctgtttctgtgattgctaagccaggctgatggctagatacccatggcaatgaagaatgtaaaatacgaaaggtaaaaaagggaaataaatcttcctttcaggacccaagctacttatcagggctaaacaaaaaataccaagtaagaatgtaatgatgaggggtggggagggggcaaaaaataaaattaaaaagaatgtaacaagcaacgagacgctcctgactttgaacctgtgtgcagggctccgggtagattagaaggcatcctaacctcagtaaatggctgtcagtggggcctgacagtctgggtcccgtgttctgggcaccaccaatggagggtatcctctcagaaagcttcaccctatttcatgagcctttaataaaatatagctataatctttctcgtgaaagagcctgacagttcatggagccacttcccacgccgcactgatgggagaaactgcaggactccaccaggctttctctggctccaggacccccacgaaggcctcctgatttatctggggcagctcctgcataagaagggtgaccgtttcccacagtggagaaccagacactgggcacagcccacttgataagacagcttccatctcccgcccctcctgggtatgcaaaggcattcctgagtgaataggttcaggtcagagcaggagaggttatcacccaggctgtgccttgaagctttgctgagtacaagaaaggtaaggaagagataagcaagaggtgagaatgacggcagggctggcaagtgagatcacgagcttttcctcaaacatctggctaagaatagaagctttgggaaattccacaactggcagattaaggtgatcagcctctcagctggaatttgtgaagtttcttcagactgagctcccagagaagtatgtgtggtggaatcgctgtgctttctaaagagatggattgcaacctgcgccgttgagctagtgctgagctgaggcccggtgagatggattctagcacccctgccacggctaacctcacacactcagacgctctccctgagcttttcatttctccatcagcaaaatctcaatcattcttactcctcgtccacctcagaaacatattgtaggttccatggagacgatgtctgtggtagacaaagagacgtgcttcaaaggcagaaaggtcactgttttatcatctttcagaatcgtgtaacccacgtggttctgccaccatcctgtcttctgtgcattccttgactttgaaagtacgcatcttttcttttgaccaagtagataattaccgtctatcgaaatgaaccctcatgcatttattcaatgagagtttgtgtgcctaacacacagcatggctgcctgatacagatacttggtttaagagaattctacaggctctgcacgaaagtgaagtcatgatgtaaggaggcaaaggactctgccctcaaacagtccaatgggcctgagaatgagcctggggtgggggttcgatgctgctgcacccccagttgtatctgtgtatcccagtgactggggcgtgatttgaatatttaaagatactcctttttcatacggcctttaaatgcaagccgagtacttctgctgcacagccggagaggtggtatgtttttaatgctggagtaaaacttgtctgtgttggacttagtgagagaatggttttcgttcagagattgtcaaggccaactttgatataaatttcactttacattttacaccacacgtgattcataacatttaactctgtcatccatagaactcggtgctgttctgatcagcaaggtagattctggcccaaaagaactggtggaggaatttaaggaactggttctaagcctaattgaggtcaccaaacatacagagaaaataatctgagaaatgtatagcagaaatctaagttttccatttattcatttactcaaaaataccctacaataaataccaggaatataacagatgatctgcattcttgggcaacttacagtgtagcaggaatacagacactgagcaccgagtaactgataatatacgcacatcagcgctgaatcggcactaagggaagaaggggtcgggtggggctgaggaatggcacagagcggtgattctcaagctctctcctcctcgagtcccactcattctctactcacgctcatctgtgtcttccaaagtttgccacagtccgtcctctaaatgcctgagtcattcacacctgttctgtcattccctgctttgatatagagatgatccaacacaaatcatgacaaaccactaagccaaatgcaagactctgaatccacagctgagtgtgatctttaatgacgactaaccatcatatcacaagttgtgtcataaccagaaacaaaacagccagagaaggagggctttaggttggtctggggacagtacggagagcccaagacgcccttgggcacccacagggggctgtgattattcaaggatggcttgatttaggcacaattaggcattggacaggatggagcatacaaatgtgttggggattaattcattaaaaatctgtcttgagctttaatagagcttcagtcagagtgtccaaccataaattctcacctgtttcacaactggttcaggcccaattgagcattaacagatttttttttttgttcatgcaaatgaggttttgtgtgtaattcattcattcatttcatttatttcatgtctaattgaacaatttttgaatagttacatttgtggagtagttaagttgtatcaaattgtctaatgtacctagtaattttgtaactaaaacagagctgaatttcattttgatataacaaaaggagaaccacagaagtagaggtggtttgaggaatagtcggcttttaagagactttatgatactctgttctttagggcaatgaccacagttgctgtttctttttatcctcacttttctttcttttcactccctaccgatgagatcaatgaaaatttggggggcatttctagatttggcagcctcccatttataagcatacatttttttagttttgtgccctgacatgcccatttttctgagggtcaaatgtgtctgtctttaaaacaccgcgttggtgtctttcaaaccacttatcaagggttgtttctcccacgagaccttgtcacccctgagcctgaaatcgcgcgctgagaactaattgcagtagctgcatacacacagtgaacaaagttcactgctcccttcattaagggcacctgccatatccactgtttccttccgagaactcttttggtgaagacgggatttttgttttctttacattccacatagctgccagaaggcccctttaaaatgcaaatctgatgtctctcagtctttaaaaccttcagtggcttcctgttggctacaggatagttgaaacccttttgtggcctatggagctcttccgaatttgggccacacctacctttctgaccatagaaactacatagagatgactgaacaccccaccccacccccacagtcacatgctttgccgatgccgattcttctgcttccagcggctgttcattcactcactcattcattcattcaatcaatagttaccaagaacataccctactccagtactgtactggagctcctcctccatttgtgagattcttcttatgtctttgacatgttttgattgtaagatgtgttgcatatgcagatgtagaaacacacctactcagtctatagaatgacaaaaaatctgtgtgcccaccacccaggttaggaaatagaacattccactagctcaggtgcccttgtgtgatcgtctgccttccgtcaccctcctgcctgttccagcggtgaccacagtgctgaattttctggttttgatccccttgcttgtcttataggttttaccacctaagtatgtgtccccccaaaacatactgtttagttttgtctgctgttgaacgttacgtaaatgaaatcatactctattctatgcccttccgtaccttcttttgatcagtatttcatttttgagatccatcttgatgcgcacagctacaggttcttaatcttcattgctgtacgatttttccattgtagatggatattgcaaaatattcttctgtgggtggatttctaacaagtttttaaaaactgattgttgaagttaatcgaacctatttctgctctaatgagatgctcacttggttcctccattaatcatttaatatggtcaattacattgtgagttttcttttctttttgagacagggtgtcactccgtcacccagactggaacgcagtgacaccaacaaggctcgctgcactcccaggctcaagtgatcctcccacctcagcctcccatgtagctgggactacaggtgtgcaccaccatgcctggctaatagtttatattttttgtagagacggggttttaccatgttgcccaggctggctttgaaatcctgagctcaagcaatcctcctgccttggcctcccaaagtgctgggattacaggtgggagccactgtacccagccaatcagttttccattaataatactaaaaattcttggattccttcctacttattctttgaggcttatctcaaatatcatctcccctctcaagccttctctgatctcctttcccccctcctaattctttgctccaggaaagttgtttccatcttccaactcaatggcattaaaatggtattttaatgtaggcacttatattttaaatatttgtttacatatacctctcctatcatatgagctcatctagataatgatagagggcacatgcagtggctcacacttgtaatcccagcacttcaggaagccaaggcaggaggatcacttgggcccaagttcaagaccagcctgggcaacatagtgagactccatctgtacaaaaaaaaaatttaaaagtatagtagccatgcatagtggcgtgtgcctgtagtcccagctactcggcaggctgaggtgggaggattgcgtgagcctgggaggttgaggctgcagtcagctatgatcatgccactacaccccagcctgggcaacagagcaagaccctgtctcaaaaaaataataatgatggaatcttgttcttcagcttccttacgattttgcactaatctgaatgaaaccagcctgatctaaaccttgcatctttagtgacagatatgagtctgacacccaccttcaactttgtggtagcctgcccagcttcccagaggacacctttgtgcccgcaggcttcctgtggccatcggatccccaatctaaactaggataaagtatatgttttgtggtattgtcacctgtttaggatgagaagaggcactgaagctataaccctattttctgagccagataaaatagcaaacatatatttgctctaccgggttattttgacaaatttatcaagcatcttcaaaatatacagtactagtctaagcattagggctaatgcagagagcttttgcaccagtaggacagaggaaaaaatgtgcacaaattagagtacaaggcataaagcagttaaaagtcacattatcaagtacattcaaggaaagaggtaagcagttccagcaagtaggccgggcgcggtggctcacacctgtaatcccagcactttgagagcccaaggagggcggatcatttgaggtgaggagtttaagaccagactgaccaacatggcaaaacccaatatctactaaaaatacaagaaaaaaaaaaaaaagccaggcgtggtggaacatgcctgtaatctcagctactcaggagcctgaggcaggcgaatcgcttgaaccccgggaggtggaggttgcagtgagccgagatcacgccattgcactccagcctgggcaacagggcgagactccatctcagaaaaaaaaagttccagcaagtcagctgtgaatattttttctatggcaataataataaacacaagatgcaggtatagattcctatttatgactacaactctccacatgtctagaatttggtggaagcaaataggtcttagaatttaccccaaagcttgaattactgaaactgcctgttagtaatagtcatttatcacatggatttggcgctggtgtcgtgaggatctaagtacagggaagttctgggcatgttcatttgccatttattaatttctgttctttgctattttttgggggggcgggtaggggagacaaaggtcttgtcacccaggctagaatgcagtgatgtggtcatagctcactgcagccttgatctcccgggctcaacagcgatcctcccacctcagcatcctgagtagctgggactacaggtgtgcaccaccatgcctggttaatttttaaaaatttttttctagagccagggtctcactgtgttgcccaggctggtcttgaattcctgagctcaagtgatcctcccatcttggcctcccaaagtgctgggattacaggcatgagccaccgcacccagccctactttgccattctttatttctcatcttaaggtggctacttagcttggcagtttccccttcttgttctgtaagcacctacgttgctctctaagtactgctttgtctgtatcctcaagttctggtaatgacaggtattttcactatcattcactcaaaatattttccatttctcattgtaattatcattttttgagacggggtctcattctgtcactgaagctggagtgtagtggtgcgatcttggctcactgcagccttgacctgctgggctcaagcaatccacctgcctcaacctcctgtagctgggactacaggcgtgtgccaccatccctggcttttcttttttcttttttttttttttggagacagagtctcactctgttgtccgggctggagtgcagtggcatgatcttggctcactgcaacctctgtcttctgggttcaagtgattctcctgcctcagccccccgagtagccgggattatttgcgcctgccaccatgcccagctaatttttgtatttttagtagagatggggttttgcatgttgccaggctggtctcaaactcctggcctccagtgatccactccctgcctcagcctcccaaagtgctggaattacaggtgtgagccactgcgcctggcccattttaattattttgtgatccgtgggttatttagaaatgtatttactaatcgccacagttacttggaatttgttccttttgagccttttaagccttgcaaaggcaggtgcagcacagcctagggctgctttgatcccactgttagcgcagtaaccttctgaggacgctgaggaatgatttacatacactcacatatatatgtacacccattatatacaccatatatattatatacaatatacacacatacccaatatgtatatacacccaatgttatatatatatatacacacccccaatatatatatacacccaatgatatatatatacacacacacccaatatatatatacacccaatgttatatatagacacacacactcaatatatatatatacacccaatgttatacatatatacacacacaccaccaatatatatacacccagtgttatatatacacacaccctatatgtatacacccaatgatatatatacacatacacacacacaatatatatacacccaatgatatatatattacacacaccatatatatatatacaccctatgatatacatacacacatacccccatatatatacacccaatgatatacatacacacactcaatatatatatacacccaatgatgtatacatacacacaccccatatatatatatactcaatgacataaataatatgcacacccaatatatatacacccaatgatatatatattacacacaccctatgatatacatacacacatacccccatatatatacacccaatgatatacatacacacactcaatatatatatatacccaatgatatatacatacacacaccccatatatatatacccaatgacataatacacacacccaatatatatatacccaatgatatatataatatacacacactatatagatacacccaatgatatatctatacacacacacacccaatatatatacacccaatgatatatatactcacacacaccctatatatatttacacacctaatgatatatacacacacaccctatatatatatacacccagtgatatatacacacacaccatatatatatacacacacatacacccagtgatatatacatacacatacccgatatatatatatatatatatacaccccatgatacatatatacacacacccaatatatatatatgtacacccaatgatatatatacacacacccccaatatatatacacacccaatgatatatatatacacacaccctatatatatatacacccaatgatatatacacagacacccaatatatatacacacccagtgatatatacacacacacacatccaatacatacatatacccaatgatacatatatatacaatatatatataaacccaatgatacatatacacacacacccaatatgcatatatacccaatgatatatatacacacacacacacacatgcatgccctgggtataaacagatctcctcactctgtctgcttgaacacagacttccaatcccttcttggcttcaaggattattccaactctcctttctgtggccttgcttgtttttttgtacacatgtggattagagctcaaccagagggctccagagagctcttgcttgctctcaggtcacctctgtctttttttttttttctctcttattctctttcccctcttctatctctccaattcttgctttgtatctctctccattcttcccttctgctattttgtcctacaaattttagctgccctgatctccccaaagtctggacttttccttgttcagaaggatgtggctgcctggctctgcttgggtcccctgtcgtgtttgggggcctggaacctctctcctggcagtaagctggggcacttacaaggctcagctcatcttttccccttctctcagacatgactttcctctgctgcttgttacccagtatcagaaacccattttttttttcttatagtttgtttggttttctagttgcttaaggttggagggtaaatccagtttctatttttcaaacatggccagaagcagaaattttgtcatttgtgatcatttttttttgtttatttctttaaacagtttaattgtctctaacatgttaatcaactttttgttgtttatttgtgatctaggtttgaacatctcattcttgcatctgtggtttctgctggctctttctcatggtgccgtgtttctttgtttatttgtgtctgggggctactcattttcactggcattttatttgtgagaattctgcaagctctgggataaagatagtttactccagacagcatttgtgtttacttctaccaggtgccagttgaggatagtctaaactacattctcagcttgaaatatttttgaccacccagatatggagaactaagcgtgcaaacctgcatgtaattcagaccagggttcgcaattctcaggacagtttctttcccctctgctcagtgcttatttcaagacagtcatgtcttgaatacctacaagggacaattattgggggttgattttcctgtgaaaattcacatgtggagcaggcctccagctttgactgctgccacataaaactcagcagggtgttacctggctgggcagatgtctttggggtgaaagaaagcttgcctgttctgcttatttatcttgagttcccaacttcacttgcttttttttggcctgaggattctttacctttttgcaggttcaacaatgcatttactaagacttaaaaataatatccacggccgggcatggtggctcacgcctgtaatcccagcattttaggaggccgaggcaggcagatcacctgaggtcgggagttcaagaccagcctgaccaacatggagaaaccctgtctcgagtaaaaatacaacattagccgggcatggtggcgggcgcctgtaatcccagcaactgaggcaggagaatcgcttgaacccgggaggtggaggttgcagtgagccgagatcacgccattgcactccagccttggcaacaagagtgaaactccatctcaaaaaaaaaaaaaatccacaacatttaactgtacttggtaagaaggttttcctaggaacccagcctatcatattgctcctttgcttttttttttctcctgttacacacctctccttcttttaaataagtaaggagatcatataacttattatcgaagccacttttgagagtgaaaagggacacttaattattattatttcatgttttgaaatattttctgacacagccgtctatattggtgaacctataaaacagttctattcaaaaattactttcaaacatgaaatgctttcttaataaaagaaaatacatcaaagtagaaaaaggttaaaactgctttatattgtttatctggacattaaaaaataagcagaataatcacttaatatacttttgtgtattttaatcattgtcttcactatcttctaataccacttcagtagtatttttcttaacactattttttctattgttaatgtcagggcgtttttctccttcacataatccaactgccttacctatatatttacatatatgtttatgtgcattaacacatcaaaccatctgtttttgataactgtggcttctgtttctcttgatagaatatcacagtttgtttaaaaataagtgtgaatttattcatacaaccaccaattacaagtttatttcagtgaaatacatttctcaattcagtgagaatattgtgtgttaaagtttcaaaggatcttcccacaagtcaatttccagagcatacttgtagaatttcacattttaatcttctatacagtttgagctcttgtcatctatatttcagggtcccctgtttgcaaattttgtttttaatcattgcaattcattacaggcttcagaggctgagctttttgtgtttcattggttgaacacttgattatggattacaacttattttgaaccacaagccatcaaaatttagatgacttgtttccaaaactggagtactttttttgtagagcatttggattgactcatgaagtatgttttaaagttaaaagctgcctaatgtcagcaatttcctatcatttcattatttcaagtgtcaaatatttctcaaatccaacttgacaggcagcaaagagagaaccgcacactctactgatgaaatgtttttaatccaatttaaacttcataaaaaatttttgtagttcagttactctcagtttatgtaaattttacacatttcaaaaactatagcttgtgcttctctgggtagaattagaactgtgtttgagctcagttatgaattacataggtacatcaattacaggtacatttcagcataataagtttctcagcttggaacattatatcttttttttattttttattttttttgagactgagtctttctccatcacccaggactgcaacctccgcttcccgagttcaagtgatcctcctgcctcagcctcccaagtagctgggactacaggcacgcaccaccatgcccagctaatttttgtatttttggtagagctggggtttcaccatgttgcccaggctggtctcaaactcctgacctccagtgatccacccgcggtcagcctcccaaagtcctggcattacaggcatgagccactgctcctggctggaacattatgtccttttttttttttttttttttgagacggagtctctctctgtcgcccaggctggagtgcagtggtgcaatctcagctcactgcacctctgcctcctgggtttaagcaattctcctccctcagcctcccaagtggctgggattacaggcaggtgccaccacacttggctaattttttttgtttttagtatagatggggtttcaccatattggccaggctggtcttgaactcctgacattatgtcttaaagtgctaactctgttcactgcacataacctcatatgttcctagatgagaccactgaaatagaaagtgaaagtctatccaattcttccatctcattttaataagtcttagtaataactacttgtattttgaataaagaaatgaaaaatccaggacaaaataaaccagacaggatgcagggtgataggcatacactgagacttctaggcaagtgagcaactggtcagccgaattaaagcccttggaggggttcctgtaccctaggttcttaatacatgcttgttgaatgaacaatcggaggtagcttatttgtttgaataaggctttctgtgtgttactgcaaaggaatgaggatgggacaggtttaggctttgtaacaagacctcccaaaggctaacacataggcggctgcttcctcggcaagcagagatgacgcttgtggccctttttgaaacaccttttttacatgccagaggtatttaacttgtccgtaccaaatggtacggacaagttaaaagggttatccgcccttttaactcaaatatcccgttgggatcaaacatttttgctctggagacctttgtacctgtgcagcatcagtataaggatagcctgggggtggtaacccagacacagctaacagcggggtctgagtggcttggccagagtcttggcctcaaattgagggcacagcagtggttctgactgttcctcttcggggaacgttgtacatcaggaggggcctgatggtaatgttggtgtaaaatgtctctgctgtgatccacccttgaagactgtgagctgtgcagaacgaagcaggtcatggcttgtcctctaggatgtgatgggaggctgaaagcatctctctgctgtgacgtaggagggaccgtgagccttatgctaggcactccttccagcccaaggcagcatcgtctactttggttttctttctttctttttttgaaacactctgcccaggctggagtgcagtggcacgatctcggctcactgcagccttaagctcctgggctcaagctatcctcctgactcagcctcccaagtagctgggacaacaggcgtgtgccaccatgcccggctacttttttaaatatttttaatagagatggggtttcgccatgtgtcccaggctggtctcaaactcctggattcagacaatctgcctgcctcggcctcccaaagtgctgggattacaggcgtgagccaccgtgcctggcctgctttggttttattctgactgtggctcctaggaagaaaaagaaaagatgatgctttggaagctgtagggttgggaagctggagacttcttgtgatggagaggtacacccagtagatacttatttaaatacttatagaaagacgactttatgccggacactgtgttaggtcctggctatacaggaagaagagaagtggcatctgcccatcctacgcagttctccaggaaggaggtggcaggagtgacatttgggccatccaggcaactcaccaagtcccttcgcagcactcctgaaaagctctgagatgttttgaagctaaaacagacaaacaaaagggaccaaagaggtggcatgagtagcatgagtcagatgtgattaattcctaattccttagctgcttctgtttgtttgttttgttttgtgtttttgagatggagtctcactctgtcacccaggctggagtgcagtgcagtggcgcaatctcagctcactgcaacttccacctcccaggttcaagcgattctcctgcctcagcctcccaggtaactgggattacaggcacacgccaccacgcttggctaatttttgtatttttagtagagacggggtttcaccatgttggtcaggctggtcttaaactcctgacctcaagtgatcagcctgcctcggcctcccaaagtgctgggtttacagatgtgagccaccaagcccggccccctatttccttatcttcttatccgcagcaggactttgagaaacggctcagttagggtcttgcagggataacagtgattagagcctgaacacaaactacatttatcccatgtcagaaatgaatagcttatcaaacgtaccaacttaaaagatgcaagaattgtgcaacaatagctaccttcttttcaaacaaaataaacatcactaaaaaactctaatcttaattctttttcaagaaatggataattcctccacatcattctcctttaaaattttgtagattctcccttaagttacttaatgtatgagttgtggcttctgtgtaacgtcttttctcaggcttgtattggtaatggaaagcattcttcagcttaatttccttttaattccttccaattactatgcactgttctttgtgccaagtgccagtccagttatccagttggtgcattttgtgagaactgtaggatcatggagatcatgtttcttttcttttcttttcttttctttttttgagacagcgtcttgctctgtcaccaggctggagtgcagtggcacaatcttggcttaccgcaacctctgcttcctgggttcaagtgattcttctgcctcagcctcccaagtagctgggattacaggcacgcaccaccatgcctggctaattttttgtagttttagtagagatggggtttcgccatgttggccaggctggtcgcgaactcccgacctcaggtgatccgcctgcctcagatcacccaaagtgctgggattacaggcatgagccactgtgcctggccaggatcatgtttctttaaaccacacatgatacccagaaggcatcataatagagttggcttcatcatcttccttatcctaggttatgcttgatttcaaaagaaatttgttcctcgacaatacacagaaaatgcacttaacaatagcccctgaagttttccccagccaatgactggttagcagtctaataaggatcatattggacaagtatctttaacacaaaacagcacagggaatcatgggccactctcatcgttaggctctcttcacaggtatagcctatgttagaaggcttctgaaccacagatgctaaagaaaaattagttaaactgaagactgatgaagtattccctacaaatgaaaaggcaatcttatatgacaaaggacactatcaggaggttgaaaaacaacctatagaatgggagaaaatatttgtaaatcatatgtctatgattaatatccagaatatataaagaactcctgtaagtcaacaaccatcaccacacccagttcacaaatgggcagaggaatcttatggacatttctccagcggagatatatgcacagccaaggagcacgtgaaaagatactcagcatcattagttgctagagaaatgcaaagcaaaccccaagaaggtaccacttcctagccagcaggatgtagctattaaaacaacaacagaaaatcagtgttggcaagggtgtggaggaattgcagtccgtgtgcgttgctggtgggaatgtaaaatggcatagtcattgtggaaaggagtgtggcagttcctccaagagtcgcatatagaattgtcacatggtccagcaattccattcctaggttacccaaaagaatggaaagcaggggagctggaggccattatgctaagtgaagtaactcaggaagggaaagccacattcctatgttctcaggtataagtgggagctaagctgagggtccacaaaggcagagtggaggaatggacattggagactccgaaggggaaaggagatggaggattaaaacgctacattttgggtacaacatatactacttcggtgacaggtgcaccacaatctcagacctcaccactatacagttcatccacgtaaccaaaaaccacttggacccctaaagctattaaataaaataaataaatataaacattcagtaacattatctttagaagaacactttttaataaacctgggcatgaagaaaaaaggctgaataatattccatcgtatgcgtgtgtatatccatatatatatatatatatatatatatatatatatatgcacacacacacacaatgtatatgtctagtgttaccaacttagtttcctttccttcaatattaaacgtctcatatttcccccagactttttgagagatagttgagaaataaagctgtgtaagtttagagtgtagtatgtgatgatttgatatatattgtgaaattattaacacaagttaggtgacacacctgtcacctgtcctagttatcatttttttttgtattgtagtgaaataaatgtctcatttaaaaaaaaaagaattgaaagcaggaaatgaaacagatacttgtataccaatgctcatagtagcattaagcataatagccaagaggtaggaacaacccaattgttcatccacaaatgaggagagaaaatgtggtatgtaaatataatggaatatacgtttcatggaaaagaatgtatctttcaatttttaatttttgtgggtacatagtaggtgaatatatctatgggatccatgagatgttgggatacagacatgcaatgtgaaataagcacgtcatggagaatggggtatccatcccctcaagcatttatcctttgagttacaaacaattcaattacactcttttaggtacttaaaaacgtacaattaagttgttatagtcaccctgttgtactttcaaatactagatcttattctttcaaaaattggttgaacctattaaccatccccacatcccccatactctcccaatacctttcccagcctctggtaaccatccttctactctctatgcccatgagttcaattgctttgatttttaggtctcacaaacaagtgagaacatgtgatgtttgtctttctgttcctggcttatttcacaaaatgatctccatttccatccatgatgttgcaaacaacaggatctcattcttttccatggctgaatagtactccattgtgtatatataccacattttctttatccattcacctgttgatggacatttaggttgcttccaaatctaatggaatatattattcactcataaaaagtgtgaaattctgatacatgctgttaatataacacggatgtaccttgcaagcatgttgagtaacataagccacaccccaaaggacaaatattgtatgattccacttatacaaggtacctggcacaggcaaattcatagagacacaaagtagaatggtggttaccgggggccgggggagtagggagtggggagttgttacttaatgggtagagtttgtttgtttgggaaggttctggagataaaggatgtgatggttgcacaacaatgtgaacgggcgcaatgccactaaactgtgcgcttagttgcaaggttacaataggacattttatgtatatttcaccacaataaaaataggaaaaggcaggtgatttctaaggacacaagtcccttggggttgctagttctgtcagacttttccccttgtttttctgaatgacaaggattagtagtggatgataatgagtggattcatggatttgagcaggacatgaaacaatttccatagacagagatgaaagggcatttctgacttgaaacctgggatgagcaccgatgcaggagaggcacgaaagctcacagcgtgttcagggcgtagtgaatagaggggtgcgtgccccgagcctgcagagcgggcagggatgtgtaggaaggcaccttcatcctcctcactcagcctcccagctccaggtccaaagccgccaaatcatctttcttgtcaccatcacatgataagggggagtccttccagactgccagtcaatgaagtaacacacacagccacggtcatgccagtctgagcccatcgggcgagccctgaggggaataacagtcttggtggcattgggcaagccccgaggactccatctcggggaataacagtcttggtggcatcggcgcttcaccaggcctcctggaaccatattcgggatccccaactgagtgctggaaagaccactggtcaggagcagggagcaggggtggaaggaggtggctcgtcctgaccttgacaatgagaatcctgttttaagcttcacgctgctgactaaacagaaaggccacggcacagggacagacgtgcgcatgaaatcacaggaagaaagacatttcacgaacaaatgcatcctcccaaaccagtctgaatccctccggacagggtgatgttaccacgcaactggcctggcctaatgagctggtttctgtcatccctcctggaaggttaccctgtaacacaaggcgtgcccactgacatgcagcctgatggagcaaggttacacctgtctgccttttgtgtgcacaagatcagaacacagtcaagtgaatacaaatgcaacagctgcttggggctcaaacttgcatagtctattttatttggatagagagcataaaattggctctaccaaagtctggaggctggaagtaatcataattgtaatctagtataattaccaagcctagacctttacctagtcctatttaacctccctttcacctttccaaggaatgtggagggataagagagtcactgaataagttggttggtaatactgtattgtatctctcaaatccattgtttttttttaaagaatgagatcaataaatataaattccaatattttcttccccaaagcaccatcttgtaccgctttggagaacattagagggactcacctgggtttccagagctggaaaacataagccccataatgcacccagtccccacggcgcgctgccatcttaggcccagtccccactgcacgctgtcatcttaggcccagtccccgctgggcgctgccatcttaggcccagtccccgctgcgcgctgccatcttaggcccagtccccgctgcgcgctgccatattaggcccagtccccgctgcgcgctgccatcttaggcccagtccccgctgcgcgctgccatcttgggcccagtccccgaggcccagtccccgctgggcgctgccatcttaggcccagtccccgctgggcgctgccatcttaggcccagtccccgctgcgcgctgccatcttaggcccagtccccgctgcgcgctgccatcttaggcccagtccccgctgcgcgctgccatcttaggcccagtccccgctgcgcgctgccatcttaggcccagtccccgctgcgcgctgccatcttagggttttgcttagggggcagatagaaaatagtaaatgaaaccctttcagatatttcctggccttatttagtaaacacgtctttttgaaagaactctgaatacacctgcagatttttcaaagcccagattctacacacttctaatgtcaaccttgaagggagatcgtagattgaattacagaaaggggtgctgtcaaaatgccacatcaaatataaacttcacatatgtttcttacctgaaacactcactcacactcatggaaaagcacaggaatgttctaaaaatgcaagtttatcacgaaggagacacaggaggttcagagacgatgaagcggcaagccgggaggaaagatctgagagaagccaccaggctggggcaggatttcattatatccagaattccacttgggctctgcagtttctttcttcctgagaattatttaaaagtccctggggaaggacaagagtaagaaaaaatcaagggagagcctctgggttactatgacaacatgactcttgaccccttctctctcacccagcagtgcctaagtcccttttgcattgctgcagagatctctggcactgtgattagcacatactcctaaacctgaggatgatttaaagtggaaggagatcaaagtttctaaatagtacaatgagctcatcttgactcaaaagatgtgtaatggttataatgcaacataactgagatgtttccttatcccccccaccagtaaagctggtcacagaccgttgcaaaggctctgtgaaaaatgacaggtctatggaaatgtctactgcaaagcactgataactcaggataatgattcaggccaaaaaaaaatttaaaaggaagtgaaacttcagacaatgtgaaacatgtcagagtcgtgtttgcattctaaattgcagtaatgatataaacatcattattcctaatctgatcctgcaggtggatcaaatacgcacacatctattaaagaacagtctgcatgctcagtaagtgcacagggtcttattaccgaatctttcagcacatcttcatttcatctttaacttcattagaatatgtaagttttggcagtctattgattcaggagaaatctatggatctattattttctatttgtctataaagtccactaattcaccttctaagttgttgttttgggttttcatcaaagtgatgacattccaactcctgattatgctacattgaataaaaataaatgtaggattttctcctttctgacctagagctaataagttgtacatattggctgagttactgcaaagaaagggcaaaatgaaaacacagctcttatagtcaaggttcttaggatcttattgagatgagctcctcagaatcagccaaacttcaaacatggagagcacggcccccagtctgccaagtcggcccaagactactgacacctactgcaagcaattagggtccaactacaaagttagcagaaagagcccacccaagaccactgtcacgtgtgacaactgcatgtttggagggttcccaaaacgaccctcaggctcgtaattctctagagggactcacagaattcacggaaaatactcatggctacaatttattatgttggaaaggagacagattaaaatcagccaaaggaagagacacatggggcagaatctaggacggtttcaaaagggacgcttccattgtcgtcaggacacattacattaccttcccggcatccgtgtgtgatggtacacgtggagcactgccaacccaggatgctcacctgagccttgtatccagagttgttactgtggtttcattacattggcatgattgattgattgatttcccatgtggtctaactcagtctccaggtggactggtactgtgtgaccccaaagcccctgccctaaatcacatggttgatccttctcttgcaaccagcttggaccatatgactatcaggtatggcccatcctaccctaagatcttatgtggccaaccctcaccataacaaaggcactcccagtgagtatgatgtagtttacctcccagaagctcatggaaaaggccacatctatctttgggaaaggtcaaattttttactacccaagcctgacctgagaagtgctaaattgtgagggtggaaaggggctagtgtgagcttggatgaacgaagtatctgaagagcaatggaaggaacatggaatgttcttaaacaacagaacatttttaggaccatagagtattggagttgaaagaatttgggagattattgcatttcttaataagagcactgccatgcagaagtggccttgtcttggtaacatgatagaagcacatgataactgtctttaaagtgtgaggggcccatgtgagcaacagggattatttttaccccatataatcctagagaacaaagccagtggccatgggttagaagttattaaaaagaagatttaagtttaatagaagaaagagctttctaataattgaggctattcagaatattacacaggctgtactgggatatggtaagttctcccaagttaaaaatattcaagcagaaagcagatcacctgttaccatggcagtgcttttattaggaaatgcaataatctcccaaattctttcaagtctaatactctgtggccctaaaaagagttttcaatcttgacagaattgtattctggaattagtggactatttctttcataagtcattatgtgaattaccttgaaaatttctaatatcgtacctgagtgccatggccttggcatgaatatacacttcctgagcagaacttaagaatgagaatatctggagtaattcaggttctgctaattctgcatggttgtcactgcgatgatgttcattgttctaggtaagaaggataaatgagtaataaaagtttcatgggacacatataagtgaactcatgttttatatccacttcagtcattcattgcaagcgagtcttgttcaatgagatcaaagcagattggttaggattttgacttgaaaccttctgttatttataaattggagttacatcatatatttcttctaaaagattctattgagactgtttgctgtctacagctggtctttctccagaagtaggttgaattgccatgaattttatcttattcagataaatagaatgctggtatctaggatccaatagattcatgtggcccaaatttcatccagacttcatcctcctctgtgtacagtggcaactattaaaatcataacagagacttgttggctccagcccatacttgcaatgtaaaacctccacttggtgcaaactctttccatccagtattttctgatgtccctgagggctctcatgaatgctcatcacacgtctcctcctggaaacaactgctgcttcaccaagaatcgcaggccccacggggaaccatcacttctctcctgcctgtcactgggcacagccaccaacattccagagccatcatggtgccagccccaaatgaccaggatggtgtcgggaagaacgcgtctctcccacgcattatcctgcctcagaggcatctcaaatgatgctgcttgcacctcagggttctacagtgtttcataaaaagagatcgatgagcaaataaatagattaacttcatgtactcttaatagttcaagacctctgccaaccagcggtctcaggataagcaagacatgacctcataataggaggtgtgctggttggatcacaaaggctggtccttcagccagagtgggtggttctctgcagggacctcttctaagctctccttgatgagacaactaatcatcgtgtacactgccgaatgacagtgtttgcagaacctctagcatgcatgctggcctcggctatctctgccaatactttattacacaagccagagtcaccttcatcggaagacttgagaacttggcttctctatcccacgaatgttatgcagtcatcttcccagcatcctgcaggacagacctgcttatgccatttgcagtacaaacaaagtactatctatctgaaattgagcagcaagtactttaacttcacgtacctctccttctgaaaatgccatcaggatagctcagcccataccaagcttctggtacttctctagtaccccaaagcaagtaattcatgccctaaggcattagcatccttgaagggaatgttgccaagacaaggccacttctgcagagcagataccttccccagaggggaggcgtccaaagtcttgcctcaaacgtaggaatgttcaggaagcagtcatggacagcgagatcatcaagtcccttaggaataagtaaactcaaataaaataaaaataaagtgattttcccttttggaggtatgtgtttcagtctggcgcaactcaacactgtcagaaataataaagacacttacttgagacctaggagaccctttggggcagaattgccctcagcagagctggtgatggtttcccttgagaacagcctttcccatgagggataaggaactgcggagatgctgctcaccttggccaggagcattgggccagggatgatggcttgggaccctggtccctggcatctcaggctggtctccaagggtcactggtgacctttcaggggacaaaagaaaaggatcttcacagatagttggctgtaaataggaaggaggcagggtcagtggtgaggaggatatttgaacagtcagcgtgtatttcaaagccgtggttctgtccccctctggtgttgcttccttctcctcttcactctgcagccgcctcttggtggtcagagggtgaatgcagggccctggggtttggggcctagggctgggagatcagagctcttggagctggcttgatacctggcaatcctcatccagcatctccatctctctacgacgcgttctggcacgttgcaggtgaagtgggtagagcgtgggatggttactggaatcgatgtagttccagggtgctgtccttaagagtgcgagtggtaccagtcagtgttctcggcatttaaatattagttgttgttatcttggctatctcatgcgtgtaagaattctgtgtgtgtagtttccatccttaaattcaaccaaggtattactgtaaaaaaaagcaagacaggcctggcacagtggctcacgcctgtaatcccagcactttgggaggccaaggagggaggatcacgaggtcaggagattgagaccatcgtggccaacatggtgaaatcccgtctctactaaaaaatacaaaaaattgctgggcgtggtggtgcatgcctgtagttccagctactcaggaggctgaggcaggggaatcgcttgaacccaggaggcggaggttgccgtgagctgagatcacactactgcactccagcccgggtgacagggcaagacttcgtctcaaaaaagaaaaaaaaaaaagcaagacaaaaactctctcccttttctagaaaagagcatgcctgtgcgtatggctggctgtgtgcctacagttcatgtgcctgtttccgtttttgctgctcaaagccatggattggtgtgtagtcaggacctgcattctctgcttggtggttcagtgtctgggatgatactgtttcccggttactctagagcagaggtcaacaaacttcttatgcaaaggagcaggtagcgagcatttttggctttgtgggcgacacaggctctgttacaaccactcaactcttattgtagcacaaaagtagccacagacactatgtaaacaaatagatgtggctgtgttttaataaaactttatttacaaaagcaggcagtgtgccagcttgggcctgcaggaccctggttggtcagccctgtgcctgagtgataacatgctctttcatgcctttaaaaatgattattaaagtgtgttcattatcctgttctttttgtcctttttcttgtttaataagtgttcactgattttaaaaagacatttttctaaaaatctgggggttttttgtgttttttttgtgtgtgtttttttttttttttttttttttttttttgacacaaggtcttgctctgtcacccaggctggagtgcagtggcgcaatctcggctcactgcaacctctgcctcctgggttcaggtgattctcctgcctcggcctcctgagaagctgggattataggcgcgcgccaccatgcccagataatttttgtatttttagtagagatggggtttcaccatgttggccaggctggtctcaaactcccgatctcaggtgatctgcccgcctcagcctctcaaagtgtggggattacaggcgtgagccacggtgcccagcataaatttattttcaaaggcaagtgtggtcagtgtaggcagggagtgaaacatgtatgcgtaaacacaactacttgaaagagcggtgcggtccttcctcaggcccccgtcagctctgctccatccccagtcccttcctgtgcctgcccaacctgtcctccatagccagggccccccaacccaaacccctccaggcaccacctccctccatccctcccgcctggctctggggagggggtggccagcggccctgcacgcttcttcctcttttctcttcctctctcttcagacttgatgcaaagagtgggctaagtctgtgctgactgttgccctggaaactcttttgaacctttctctttccctccaaagattccgagttcctcctacagtttgcagccttcagtaccctgccccttccctcccctgccctcccttacttggttgtctttattccaagttaaatgatcatcatgaggttgggaaagccgcagctttctatgcaccatgttttactccccaaaggacatcttttagagtccgcagaggcccacatgaagggctcaccagcagctctaccggtttgctttccacaaggagagctaaaatgccggttgctaagcagcatacatgccgctgcttctttccacaatgtagacttaaaaaaatcgccgtaaacattttaccatatgattgagtcaggtgtggggagtcgcagtaaacattttaccatgtgattgagtcatgggtggggagtcgcggaaatacacagggcaggcagttcgctatcacgatgttctctctcaattctgtctttggtctgtcttcctgggtaatgtcacatggagacccaggggatctgccgtcagctgtgtgcagtgggttaacaagacgacggggaacttcagagtgcaggcagtcctcatcttttgcagattctgtatttgcacattcacctactcactgaaatgcatttgtaaccccaaaatcaatacagcggtttcacagtcattctccgacacgggcagaggggtgaagatactgagtcgccagatgcacgcgttccccgccgaggtggagcgtgcaaagctctgccttcacgtttggctctcatatcgtgcacatgtgtcctttttgcagtctccttagcactgtgtttttcatatttttgtgctttctgatggttattttgctgtaaacggcccccaagaatggtgctgatgtcctatttagggtccctaagcacaggaaggctgtgatgtgccttatggagaaaatccatgtgttagacacacttctttcaggtaggagctacagtgctcatgggggtctagtgttaatgaatcaagaatacacacacccagaaaaaggaagaggaagcgcacagggcagccagcttgatgtcaccacgttacatccttttatccggtctttggtaagttttcttttcttttttttttttttgagacagagtctcgctctgtcgcccaggctgaagtgcagtggcgcgatcacggctcactgcaagctccaccccccgggttcacgccattctcctgcctcagcctcctgagtagctgggaatacaggtgcccgccaccacgcccagctaattttttgtatttttggtagagatggggtttcaccgtgttagccaggatgttcttgatctcctgacctcatgatccacccacctcggcctcccaaagtgctgggattacaggcatgagccaccgcgcccggccggtctttggtatgttttcttggggacttacacagggtcacgtggagatacagggggatgcgccttcggcccatctgtatgtggggccactctggaaagtgctaaggtaacagctatagtacatgaggaagccatggaagagatgaaaagtggctgaatgtgtggattcatcagatgatgagaacatttaatgtaatagatagcattggtgtgaggctagacaccaaagaaatgtacaatcatgttacccaagggaaggaaagtattaaacccttcttggctagtgttttattttaaagaaataccaaatataattcattattttgaagaaacgtattaaataaagcatcttattaacaaggttacgtattgaccagttgaagaaacttttgtcatcagaggttcacagaaacctaaaccatacgttaggttggtgcaaaagtaattgaaatgggccagatgcagtggctcacacctgtaatcccagcactttgggaggccgaggcgggcggatcgcctgaggtcaggagtttgagactagactggccaacatgggtgaaaccccgtctctactaaaaatacaaaaaattagctgggtgtggtggcgcgtgcctgtagtcccagctactccggaggctgaggcgggagaatcccctgaacctgggaggcggagattgcagtgagccgagatcgtgccgttgcactccagcctgggcaacagagcaagagtctgtcttaggaaaaaaagaaagaaaaaaaaagtcatcgaaatgacagaaaccgtaattacttttgcaccaaactgtatttcccctaagaacaatggcccagtatttacaaattcagtgttcacaaatattttatagaacacagctaccatgaataacaagagctgactgtatatgatcacaacctaactgagcagaactcaccctccactactcatgtaagacctgactgtatatgatcacaacctaactgagcagaactcaccctccactactcatgtaagacctgactgtatatgatcacaacctaactgagcagaactcaccctccactactcatgtaagacctgactgtatatgatcacaacctaactgagcagaactcaccctccactactcatgtaagacctgactgtatatgatcacaacctaactgagcagaactcaccctccactactcatgtaagacctgactgtatatgatcacaacctaactgagcagaactcaccctccactgcgcatattgaagacagagcccaagacgcatccaggtgcaacgtctctgctaagaatgtgtgccaggaatggggcctggcttcctcgtcgagtgcggctgtccgtgggtttctgctagacagataacgttctgaaggagttaaactttcacagctcctcctcctcctcctcctcctctatatcccttacctcgccacgttcatcactggtcattttgctggaagggaagccctggtatattcttacattgctctggaagtgagctttagcccagcgtcgccaaacttacaccttaattgatcccagatgagaaggaaaagctattgctcttaccccacagtcttccctccctgaggccagaagcaggtcacgtgtaaaatggtctgctctctgctgacagtggcctgagtctcccatagtgtctgctgagctggatagtccctctccagggagctttgcaggggatgggtgatgagacatggacatggggacgaattcctctcatctggaatcgcagacacagcatggagatatgagcacgcggcatgggaaataggcttcctcagcccttcaggatcagggaacgtgccagagatgcaatgacatttggcagcagttgagagtatgagtgctgttgatgaaataaacagaggcctttaaaagcaaggcaggaaaaatgctgggacgagtacaggaacagaaaaccagccatttctccaggtctattcaaagacgtagcaacactccctgcaaaccccagggcctcattatcaccactcagggcagtggccccgcacagcacctgcacagttgccagaggaggcctctctataggaagtgctgctttctgttgtggatagagtgactggctgggcctctctctgtgtttctcccctagtcttcaggaatatgaatgccttttccttcagtgctactaggtgcaaatatgcgagttaagggacaatgccaataaagtagccgcagtttcctggctaaaggaactgtgcaggtattaaaaacccaccgatctttaatccaggttcgtggcagggggactcctttttgttgcaagattgtctgtgtgtggaaaccctggagaaaggccacacgtgcagtcagcaagccgagtcaccaggcacagagccctttctcctgatcccctcctcttgtttctattcccaggcctcattatgtataatgtcacagacacacacgcccaggaacatcccatcacagccaggacagaagcgccaagggaggtgctttgcacagattccatcttggagttagaagcacttgctcggtgcttgccaactacaaatagccccatgctggaaaatgatgctaattagtatgccattaaaaagggtggggggaccaccacccacaacaaaatggccgtgtgcaggcctgaagccctgccctgagggccacagggaagcatggccgctaatgcagcctaattcactttgtttggcagagagagcaagctcgccatgttgctgcgggagtctctggggaacatgaactgccgtaccaccatgatcgcgcacatctcggccgcggtcgggagctacgcggagaccctgtccaccatccagattgcatcgagagtcttgaggatgaagaaaaagaagacgaaggtaaggagctcgcggggtgggggggtggtggatgagggagcctttggagccgtgccctggaacagagtcagaaaaagccaaatcaacgttgccaatcccccagcatcaggagatgtgacttggagctgacaacacgtggctcagggtccactttggggcagggaaaccttggggctgatacaaagtcatgtcacctccccacacctggtgctggccctggtcacccagcctggacccctgaccggaagcacttggtccgctttagagagtacaaatggattgctacctcaagaggaaaaacgttggagggatggaaaatattgtttttctcatgcatggcctcggtcctgcgtaggtggagactgtgtccttcgaaggcttggcaccaaagaggttctcaactccctgctctcagggcccctcccctgctgcatgtccaggagtcactccctggctgctgcttttgtcctggcaattcagtggtttctggatgatactgagtctgctggacatcgctgggctcattttctcaggcagaggccaagccaggatggtggcagggtggcaagtagttgagaaaaccatcatgatcgtggccactcagtggcaggggcagctgctgaggtgggggcctttttcccccttctctgttttgtaccttttttatctttaaatagcgtttcttaaccagagttccacggcacagggtgccaaacattggtgagccagcagcccttagctggtcaggcagggcctggatggtcaccccctttcctgagcagctgtttccccagcgtgccacacggggcttccccttcacaaatgcagtggtgatgtgacaccgggcgcgcgggcatggcaccccgagtggcccacgtgcgggaggccaacgggggtggctgtcagtagcctgtgtcgtcaggggccttcaccacttgccgcgcacagctgggctcccggggaaactgccacggaaaggccaccacattaactgccgtctcactcacagtacacatccagctcgtccggcggggagagctcctgcgaagaaggccgcatgcgcaggcccacccagctgagacccttccacaccagggccacggtggaccctgacttccccatcgctcacctgtccagcgaccccgactactcctccagcagcgagcagtcctgcgacaccgtcatctacatcgggcccaacggcacggccctctctgacaaggagctcaccgacaacgagggccccccagactttgtccctatcgtgccagccctgcagaagacccggggcgacagccggcccgcagaggcaggagaggctgcagccggcaagtcagaaagggactgcctgaagtgcaacacgtttgccgagctgcaggagaggctggactgcatcgacggcagcgaggagcccagcagctttcctttcgaagaactgcctgctcagtttgggccagagcaggcaagcagaggcccccggttaagccaagcagcgggggcaagcccactctctgagtctgataaggaagataatgggtccgaaggtcagctgaccaacagagaaggccctgaactcccagcctccaagatgcagaggagtcactcacctgtgcccgccgcggcacccgcccacagccccagcccggcctcacccaggagcgtcccgggcagcagtagccagcacagcgcctccccactcgtgcagagccccagcctccagagcagccgggagagcctcaactcctgcggcttcgtggaaggcaagcccaggcccatgggctccccccggctgggcatcgccagcctgtccaagacctcggagtacaagccacccagctctccttcccagagatgcaaagtctacacccagaagggggtcctgccgtctcccgccccactgcctccctcgagcaaggattccggcgtggcgtctagggagtccttgctgcagcccgaggtgcgtacgcccccggttggaatgagcccccaggttttgaaaaaatccatgtctgctgggagcgaagggttcccggaaactcctgtcgatgatgagcagcaggcagctactccttcagagtccaagaaggagatcctgagcaccacgatggtgacggtgcagcagccactggagctgaacggtgaggacgagctggtgttcacgctggtggaggagctgaccatcagcggggtcctggacagcggccgccccaccagcatcatcagcttcaacagcgactgctctgcacgggccctggcctcgggctcgcggcccgtcagcatcatcagcagcatcagcgaggacctggagtgctactccagcacggcccccgtctccgaggtcagcatcacacagttcttgcccctcccgaagatgagcctggatgagaaggcccaggacgcagggagcagacgctcttccatcagctcctggctgagcgagatgagcgcgggcagtgagggtgagcagtcgtgccacagtttcatagcccagacgtgttttgggcacggggaggcaatggcagaacctgtggcctcggagtttgtcagcagcctccagaacaccgctgtggtgtgcagagagaagcccaaggccagccccgacaacttgctcatcctgtctgagatgggagatgactctttcaacaaagcagcccccatcaaaggctgcaaaatatccacagtgagcaaggccatggtcaccatctccaacacggccaatctgagcagctgcgaggggtacatccccatgaagaccaatatcacagtttacccctgcattgccatgagcccccggaacatccaagagccggaggcccccaccgccacccccaaagcaggccccacattagcccagtcccgggagagtaaggaaaacagtgcaaagaaagagatgaaatttgaggacccgtggctgaaacgagaagaggaagtgaaaaaagagacggctcatcccaatgaagaagggatgatgaggtgtgagactgccacgggcccctcgaatgctgagaccagagcagagcaggagcaggacggaaagcccagtccgggagacaggctcagcagcagcagcggagaggtgtcggcctccccggtcactgacaacttcaggagggtcgtggatgggtgtgagatggccctgcccggtttggccacccagagccccgtgcatcccaacaaaagcgtcaagtccagcagccttcccagggcctttcagaaggccagccggcaggaggagccggacagcctctcctattactgcgctgctgagaccaacggggtgggtgcagcctcgggcaccccgccctccaaggctaccctggaggggaaggtggcttcccccaagcactgtgttctggctcggcccaaagggactccccctctgccccctgtccgaaagtccagcctggaccagaagaaccgggccagccctcagcacagtgccagcggcagcggcaccagcagccccctgaaccaaccagccgccttcccggcgggcctcccagacgagcctagcggcaagacgaaggacgccagcagcagcagcaagctcttcagtgccaagctggagcagctggccagcagaagcaactcgctgggcagggcgacagtcagccactacgaatgcctctccctggagcgggccgagagcctgtcctccgtgagctcccggctgcacgcgggcaaggacggcaccatgccccgcgcggggaggagcctgggccgcagcgccgggacctcgccccccagctccggggcctcgcccaaggccggccagtccaagatctccgccgtgagcagactcctcctggccagccccagagcgcgcggcccgtccgcctccaccaccaaaaccctcagcttctccaccaagtccctgccgcaggcggtgggccagggctccagctcgccccccggtgggaagcacacgccctggtccacgcagtccctcagcaggaacaggagctcgggcctggcctccaagcttcccctgcgggccgtcagcgggcgcatctcggagctgctgcagggtggcgcgggcgcccggggcttgcagctgcgggccgggcccgaggcggaggcgcgcgggggggccctggccgaggacgagcccgcggccgcgcacctgctcccgtcgccctacagcaagatcacgcccccgcggaggccccaccgctgcagcagcggccacggcagcgacaacagcagcgtgctgagcggggagctcccgccggccatggggaagacggccctgttctaccacagcggcggcagcagcggctacgagagcgtgatgcgggacagcgaggccaccggcagcgcgtcctcggcgcaggactccacgagcgagaacagcagctccgtgggcggcaggtgccggagcctcaagaccccgaagaaacgctccaatccaggtaggcggctgggcgcagggacgcgggtgaggagggcggcaggtgggcgagctgcccaaaccccactgccagggtgtcccgtgccctggggagggggcgtccaggcctggcctctccttgcaggtgggcgaactgcccaaaccccactgccagggtgtcccgtgccctggggagggggcgtccaggcctggcctctcctttcccacggcccggcaccccgcggggctccgccggggacatcaccgcggagggtttctctgtgagaaactgccctactgcgtgccgtcatcaggcttagggccgtgaatcccttggcgctcagcagggtggaaaggcgagggcccggatgcaggtggcagcatgacccgcacctgctcgctctgggggcagcctggctcttcgccgtccattccctcacccctgcccctctgttcaacaaccaaggatcctgtggacggtttacagcctgttgagggatcaggtgagggtacctaccctcatgacctggtggcttcagaagcccctcctgtgaggttggtggcctgcaagaccctggcagcctctctcagggatgtgggataacgcacagattgtcccattgaaagtggaatggcgaggcccttcctccacctccaccccaaacatatttgtggacagtcatgtttgcacacctgccacagggcctgcagtgccccccgccacacacaccatgatgcctgaaatgcgtgattttggagaaagtctttgccatttctttttttcctttttttgagacagtcttactctatcgcccaggctggagtgcaatggcgtgatcttgccaaactgcaacctctgcttcctatgttcaagtgattctcctgcttcagcctcctgagtagctgggattacaagcgtgcaccaccgtgcctggctaatttttctatctttggtagagacaaggttttaccatgttgaccaggctggtctcgaactcctgacctcaagtgatccgcccgtctcagcctcccaaagtgctgggattacaggcgtgagccaccacacccagtcagtctttgtcatttttaagaatctcctatcaaaaggcacgtactccagaataattaatatataaagcccacagacttgttaattggagtcttgggtggcacatgacagtaagttatgatgggcaaggagaagaggacccgggtcagagctggtggccctggaggtcttggggtaggagaaatgaaaggatggtaaggagagaaaaagacagacagaggcaaaagttcccaagaacaactgaagctacttgagaattttgcctggaatcatctctgctcataagtggcttccaaagaaattacccctgctcatcctttaagggcttaaaaaaaaataaatgaaatttacgcagaaccccacgtgcaattctgtggcttggttgaagccagggcggccgggttcctgccctcctggcctgtctctcccctcccgctgcccttctgtgcaacactaggctcttcacatgctctcagaagccaggtccctgcagggatccgtgcccgcagcatatgtggaagtaaaagatggggtgagacacagatgtagggcttcccctttcctactgctccagcaactgccccacaggcttgttctctgtcatggggtggcttcttcctgttctcccaccacaggcgagcacaaactctggaatgttccaaatgtaagggctgtggtcagtgaacattataaaccattcctcttcctagaatcaaagaaatccaccttaagggatggtgtagttatgcagatgtagttttatgatatagacagccccatccgctcccctcatcacagatcacagaacttggccatggggatgttaggctctaagcatggtagggaatcatcgtggctgtcagtaccttgacatctttatttgcctggggggggggtatgcttcagtctttgatacgctttgactctgctttacttcacccctcaatctcggtgacagcacttggagcagaaccccatttaagacaagttgaaaaggaagagccattccgtgtaacgtagcagcttctgtgtcttatggccagggccaagggcattgaaacgtattgatgagagtaaaaataacaagcaggaaagcatctgccggccttcccagtacctggttaatgaactcttgttattctaatccacgcagcctcggtcttcaaagtccagatgactgtgtggcatcggctgcgtggccacgtgtgtttcagtgtcccacagtgctttcatggactcaaatttagtgccttgcgtctaccagtccatttcattatttccgtggctttcacaggtttttgtttttttccccaagacttttattgtttggtttggcggttacagtggagtaaagaggaagaacaatgatggaaaaacaaacgtgtgaagtgactgcttggcgagcaggcagcaggctctgcatacgcccttgctctgggctaagtgctctcgtaaatgctgtcctctaggagcctctggttaggtaaggctattggaggaaaacagtgtaaaattaaaatgccagggcaggtgctagaaatggatttcatgtggaatgtcaagagcagaagacctttgtgatgagctgctgtagatccaggctccatgatggatgtggcagtggagatgtgctggtttcaggttaggtgaccttgtctggcttatttatgattattattaagagaaacggtggctgtcagacatggtcagcataaatcaaaagcaacttctttaagagaagctataaaactcctccaaggaaattcctaactagatggctagagtttacaattatgagaggtgtttggaaccagagaggagacatcttttgtctgagatggcttttgaatttggaatattttaatgcttatttccttagtaaaaatgaactagaattattgggaaaataaccttgacctctctgattccttggtagtacatgtaacagcagaaacgaccaaatatcaccgtggttccttcttgtcttctcattcttggaggtccatgttgctgaggagtgtgcagcattgggcttgttccaccggccatagcagggtgcagtgaattaagttagaaagcaggaggaggcttagaatcttgagctgtgtgacctttggggaataactgtcctctttgagcttcaattttctcatatgcaagtaaaacgagaagattgataggtaatagccatggtctctctgctgcccacatcatatgagactatgcagataatttaaataatgttatggtcatgtgatgtcttttccttagagcaatctgtagtcagtggggtttattttcagttgttcaacattgaccaggtatcttctgtgctcttagagcttggtgatagtttctggtgtgtgggtggaggtggaggcagccggcacaggggacaaggccactgtaagaagtttgtaatctaattggagagaaagggtgaaaagcgtggaatagagaacagtgaactgagtgcattcccagatgctgagtggggtagtgaaggcccaagtggagagagcatttagacaaagcaggatcctgcaaggcaaaggctgcagagaaatgtcgggattgagcttggtccgggagggtgcttacatcgggacaggcagagagggcgcagggcatcgaggctgaggcagggatgggactgcaaactcccagcggcaagagcctggcctgtgggcgacacagcgagattaactcaaggagggaccgtcccagcaagcagagcaagacgctagcaaacgcaagccacagtcacacccggaacaaacacaagccacagtcacacctggaacatctgggagctacaagaacagtacacattattctatattctacatagttctaaaagaatatcagtatattattgtagttggcaatggggagtcattacaggctcttgaccaacaacgtgataaggtgagagaaatgatgttgcttttattgatggattttcattgcttcatccacagctccttgccagcccctctatggtcagcaagatgaaattgtgtatagcccagagccaagaatgagcccaggagggaagggaatgtctgtcctggccagtgcacatatcagcagctgaggatgtcaatctgtgatacacagttgatgccataattacaccagctgagcccctaccctgagcccccagtcctcgcgctcccccgtcccctatcatccattatatgttatgtcaatcctattttcttcctccagtctcttaacatttcaccctcatcctggtgtgttacttccttggattctttcccttgctttccttttcttggactggatggggaagtctgacagttagatgagcaccttggtctgaattaaattcattcccaccacagggaggctcagcaccagaaaagccctggagtgagggagggtctgcctgaagagaagcccctcagggaagcatggaggttctggaatgctccagaccttggcccgcctggacatgagcaaggcctgttctgcgctcgacccagcctgcttggtgcccagcactgggctggtgcaggttactgttggatattattggttgattcattgatgggctggttgcttggttggcggcacagtcctgaaagtttactcatgtttattttctgtgtatttctcatatcttttcctgctggtgctaagtgctttaagtgttgagtctagtctgctactttgtcattctaagcgccagaccctgtgcctttctcttggtgctgagtcaacattactgactgatgggcctgtcttgtgagttgtgacttgcacctgtagtgaattgagctcccaggctaccaggttcagttcccagggcgctgcacaaaaacttgtgactaattgctcctcaccgagggcaccatggtttgctctgccaacctctcctattcgtttggttctcaggcacatcctggttttgttttaataaattcaagcagcacagtgatcactggcttaatgaaaaccagaggaaggcaagccgcttgctgtcagacttcagatttccagaatgtttctaagcgaaccaacctagagccagttgagaataggttcagaatgagagcctttttgaatacacagttgggggaaaaggaggagagtcattgattctctcagacaccaaggaagctccttagaatagaaccccaaagagagtaggtggcgctgatgctgtgagatgacactgtggtcctaggtgcggggttcggaatcgcagagaacacgggaggaagcccaggctcggcatcgaggagagctttgtggccctggagaacctgcctctttctcatccccagcacgggagcacttgccttttcagctaaaacatgacagcaggccacacagccagcatcgttcttcatcatggagctggccccttcctggtcaacaaaatcacatggattgattcacattctctttctctctctgctctgatatctacagttcctttcaacattagtgcctcgtgcttttttgactgtcttcctagtgcctactctttgaatcagaatgcagacagtgggcgatggagcgaaagccatgctggagggctctcaggagcaggagtttgggaatgggcagaagcatattccccagggggagctgagagggctcagcactcagaacacccatgtttcccaacacttaacctcagcagcagcatctgcagactcgtgtggggacttctgtctggactcagggatgttaagagtagaaggcccaatgtcagcttctcacgtgggctgtcagcaccgcagatgataccggaagatggactgtgatgggccagcgacccctctgactgcacgcagctgtcagccaggcctggaacaggaggggcgagggggtgggctcagcctctgttagtgggagaggtcctggttggaagtttcactgaagtatcagtgttgactttctcaggtcaaatctgggccatttcatgcggtaaatccatgtcggcaggtatcagcccaagtgttttgaacatgctgcacttgtacatgcctggaccaaatgccaggctgatgagcagggaggggttgaaaagcagaagggagcccaacccaccggcgtcagcaggaggctggccctggctgtggctccccgatcagacaggcggcgtccaatggggcaccacacgactcccgccagggtggggcttcccctgtacctttcttagagctgatggtcccctgaccccactcgcagcctggaaggaggggatccctggcagagaccgggcttggcagaaaactgggcatctgcttgagaggtggaaatgctggagcatgcagaaaatctaagaacccttatttatatggggccccagaccaggaccctcgggtcagtctttctttgcccagggatggcatagcagtaacatcgcttcctgtgccctttccagtaatgtgagggcaccatctccgcccctgaactcccttcaggccacttcactccatttcctcagcctgaccacattacccctgccccagtacttggcttccctcaccatcacctaagtgaagctcacatgcacctctggagggagacaggcgcggggagagggagcctcagctggaggtgcaggaactgagtatcaatccattcacgggattgaggttctggtacccaaattcagaattttacgaaaatccaagacacttgttcattcgtgtgcaggaaaaaggtattcctagcccccaaaccacacctaacctgacagtgggcactcacttcaccttgagagggatcgatgtggtgaggaagttcaaggttgctagatggcatggaaaggaggcaatgggaaggaagtagatacccgccaggatatttctgtgaagctgttgtagcccagtgaaatgtcactctccaggtgtttttaccttctctactcccagctcacacggtgccctggcacgggtattggcaggactctccaggtgtttttaccttctctactcccagctcacacggtgccctggcacgggtattggcaggactctccaggcgtttttaccttctctactcccagctcacacggtgccctggcacgggtattggcaggactctccaggtgtttttctctactcccatctcacacggtgccctggcacgggtattggcaggagatggagggtggctcttatccaagacattttcccatctgatcatatcccatccgcggtagccaggctccaagatggcccccatggtctctgcctcctggtgttcacacccttgtgtagtcccctcccgtatttaccagagttggtctctgttgagtgaggtaaggcagagtgatggtatgtcactttcaaaagtaggttataaaagacactgcaccttctgtgctgggtgcccctcttgctttcttgggtcattccctctgggggatgccagctgccatgtcataaatagtcctgtgtaggagaggcctgcatggcaatgaactaaagcctcctgccatgatgacatgagtgagcttagaaatggaagcttcaacctcagtcaagccttcagatgagtgcagccctagctgacagcttgcctgcgactccgagaggctctgagccagaaccacctggcaaaaattgctcccagattcccaacccacagggatatgtgagatcaatgtttgttgttttagccgctgggtttggggtttatttgttacacagcagccatttggaagctagagttgaggcacacagaagctaaacagtttgccaacaaacagtcagctagcttgatcagactgatttaaaagaaaaaaacccctctgatctggtcccttcccagggtaggtgtctcacgctaaggagacagacatttgctttattcccgtggtcgatgttacttagtttcgttagttggggcctgcactttgttggaaactaaatgcgattgtgtatgtgtctacacaagatcaaatctgggctctaaaaagtgaggttttggccgggcacagtggctcatgcctgtaatcccaacactttgggaggctgaggcaagtggatcatttgagatcaggcgttcgagaccagtctggccaacatcgtgaaaccctgtctctactaaaaatacaaaaaattagccgtgcgtggtagcgggcgcctgtagtcccagctacttgggaggctggggcaggagaattgattgaacccagcaggcagaggctgcagtgacctgagatcacaccactgcactccagcctgggcgacagagtgagactccctctcaaaaacagtgaggtttaatatgaagcaaaaggagctcggagcccagagttcactccatagagaaaattaacacagcagtgagtgccccttgttgtctcctggaggaggcatgcttcagctggcatctgctcatcaaaacgtcagtcccctgtaccatgcaagagtttagtctccattctgggagccatgtgcttcactaatacccagggtctcttctgctgtgaaagaaagaggatagatactgggagagaactagccgtcctcgtcacaacgtgtgaagtgtgtgaaatagtaccaggcacgtaaccagtgcatgtgagtgctactgctgctgttataagcaaataaacagtgttttctggaactcctgtaatgacatcaaatgctaggaccttttgacctatccatgctgaggatgccccctaggctgcgtgttttacaggtggaaactaggaggcggttctaaagattcctcagggagtttgctgagctaaagcccaagtgttggtttaggggagtagaggtggaggtgggtggtgggaagtgggagtgtttagccctacctcagatcctggggtgcttgtcatgacctcctctgttacatccacaaaatatttaaaagattgaaattcaggcttcagctgaatttcagggtgtagtggctcacacttgtaatcccagcacttcgggagattaaggtgggaggatcacttgaggccaggagtttgagaccagcctgggcaatatagcaagatgtcgtctctcaaaaaaaaacatttaattagctgggtgtggtggtgtgcacctgttatcccaactacttaggaggctgagacaagagaattgcttgagcccaggaattcaaggctgcagtgagctatggatcgcaccactgcactccagcctgggcaacagagcaagaccctgtctcaaaaaaacaacaaaaaaattgaaattcagaaagactaactctctgggcttatccccctcctcaggttctcagagacggaggcttatcccagcactatccctggacacctcttcccctgtgagaaaaccccccaacagcacaggcgtccgctgggtggatggccccttgcggagcagcccgaggggccttggggaaccctttgagattaaagtctatgaaatcgatgacgtggagcgcctgcagcggcgacgagggggtgccagcaaggtgaggcagcctccttcccaccccctgcctacgtggtggcagctccccaccaagcctgagcaggtgctaggcagggccctggggaagaaaactcagacccgggcttcccagcgggcttctggcatgggtggtgggaagggggcttctgtcccagcaaagggcctttggacagaggccttggagagagccccatgtttctcttcctgaaatgttttaagggcttcaaagccaggggtcgggggctggtgatcttgggggcttttctggctccttgaggctcccagtcttaaccaacctttgtccaacttgaacacccaccacctgctttctcaacttaagaatggcctgtcatagtccaaaaatggtctgtcatagtccaagaatggtctgtcatagtcctaccttgtgaggtgtctgaattgaggtctgtcaagggagaatttggtggggatgacccatgtccctcccacacgtctccaagcccagcctgttttccatcaacgatactcacaggtgctcctgtggtgtgggctgggtgtgagcagaagggccctttctcctctctgtctgtgtgctaggaggccatgtgcttcaatgcaaagctgaagattctggaacaccgccagcagaggatcgccgaggtccgcgcgaagtacgagtggctgatgaaggagctggaggcgaccaaacagtatctgatgctggatcccaacaagtggctcagtgaatgtaaggccggggtgccttcccacccttgtgactagtgggttcacctgctcaaccgggctggcgtgtagcccagggtgacagtgacacaggctgtgtcctcgtcctcagtcacaggatgcccatcaaatggaggaagttgcaccgagcgagcagccctactcccctggggatgggcgggaggggccgggacagcagaggggtggtgaatattgctcttgcaagattatttctacgtgtctcagtccaaagcacctgaaaatgagatttttccccctgcgtgtggcagaagatcacccagacatgaaggctgtattacaaatctcctaggccacaaaatcacactgcatatctagcctgaaatagacaagaatttatagagcccttaaaaaggtagagtgtacagtcctcgaaaagccacgcagagaacccagaaagcaaggaaaacatttttgagtggaaaaaaaaaaaaaaagacagccacagtgttatttccatttaatagaaagcccaggatgaccataaccatctaataacaattcaggacaattttgctctctttgaaaggtggattcaattgtcttgtcttattagttcctgaccattccatttagcacaaaataaaacttcagtctggtcccagctattacacggatataggagctaatgctggaagactcagtctgtggggtgaaatacattcctgccattcaagttccctctgcctccccttcccatccagccctcagcctccggcaggcctcctttgtacagcccctcccctgcactgccccaaccctcttccagtcttccccagccagtgtggagggcctacaggtggaggctggaagcttaggtttatgttccaaagcagctggttgaaaagatattggtgtgaaatggtcctgggtgaaggtgcggaagaaagtggcaggacttgtcagcctcccagctgtgccttccacatgtaactgcagtctcgcagcagctgcctctccacagggataaggtgataacaacatttccctaagtactcattggattcttgggacagtctgtggagcattctataatataatattaagttgcagcatttgccgctgtggccacaggcatacagacctgctttggctgctggctttctcacatactagctgtgggacctcaggtaagacacttaactctgagccttgacttccttagctgtaaaatgggaaaaataatggtgactacaccatagggcagttgtgaggtataaatcagttcccgttggtcctcttggtgcttactacactgcttggcccaggatgagagctcaggatctggtagtaattattactattatcccaaagttcaacaacaggagacatttcctggccaggcacggtggctcacgcctgtaatcccagcaccttgggaggccaaggtgggcagatcacttgagcccaggagttcaagaccagccttgacaacatggtgtgaaaccctgtctgtctctaccaaaaatacaaaaattagccgggcgtggtggcgggcacctgtaatctcagctactcaggaggctgaggttgcagtgagccagagattgcgccagaccctgtctcaaaaataaaaataaaaaacaggaggcatttccttcgtgtctgcttgcatgatgcactgaggagttggatcttctgttagaaatttgagcaaagaaagacatgaactagtcctgcgagggcctttcatcgaaggcgctaatggggagggcagacaggggcgagggcgctggttactgtctgcgcgtgacatgcgcacggggcgctgtgcttatccctccccgctgcggatacccttttccttgtttcaggaatccctggccacttcaagatcccaggggcctcctttcagtcagtcagttctctctccttcatttttgctattttcattaacattttattttcaagaactgtttatgcccaaggcagacttgacttgaaaattatcttcatcttacaaagtcagtcatatttttcccaggatgggaacaagctgaaacatcaatacatatgtgtttagatgcttccaggaaacaattgcttccttctagtctttgtacatgtcaaaaatcactgtgtttttgatgctgagaaagaaaatgaacagaaagctacatgaaaggggaaatatatattgtttcttgaagatgaattgaaaacagtaatgaaaaaaaggatcaatgagctgcctgctgactattccctgtgggcatgaggcaggggactggcatggaaagatccatttttagttctattatttcttcattctgatgccacttttaaggttgtccagtaatgtagtctgatgtggtcatagaatgatgtctccttttgcttttttgttttggtttttaaatattaaactggtattcagggccttcggtctccttccagctctagtcctggttaactgtgtcagcctcagtgagtcacgtcactgtccagctctcagggacctcatctgcagaaagaagacactctgcagacagcggccactctaagccccagtgtttccatagcacggcatcgttttcaaatcaagttcgtgttcattattatctcattttattcttcacagcaactcaaggcaggcagggcaggcagcgtaggagttactattctcacatgcctttaaagacactgtcagcagaggtggaggtcccagagctcgtctcttcagagcttgtctcgtgcctggggttccagggccatcccaccaccttggactgctgtccacgcctctcctcctcgtactgggagcctgctggacccctggacctgggccaggcagcccatccctctgcccggccacctctggacaaagcaggggacttgatgccagaggggttgatcccagatacctgctcttcaggcctggaatgatacagactttttactctgtgcaggcctgaacatcaggaaaggcatctgggttataatccagaaacgtcctttcatataaggaagcagaggtataaatgtcactcaactgagacccccaaaagggagggactctccccacctcaacttgaattatttacttgattgattgatagtgaatagtgtggtagcgtctctcaaatcctgggatccatcctggatcctccatggctggaggtagggggagctagaatgtcaccttattggtcagtagaatctcagaaaaaaccttaaggatctaaatactggtaaagagtgttcctttcaacccaaaagaggccgagaatcaggcaggagggaactctgcagtggcctaaggcaagcgaactagacctttagaccaaggggtagatgtgggggtggcagctccaggctgagccgtcgggagttgcttctcaccctgtttgctctgcgtctccatcaggctcttcctctcttgcagttgacttggagcaggtttgggagctggattccctggagtacctggaggcactggagtgtgtgacggagcgcctggagagccgtgtcaacttctgcaaggcccatctcatgatgatcacctgcttcgacatcacctccaggcgccggtagatgagccagacccttgtcctagtggtcccccgctccccaggacttcagagatgttgcacgcccctaggccctctgtgctggggcatcaaagacaatgaatgaggatgaaggttggtggcaagtctggagcgggcgttgagcggaaggcgagttttcttttgttttctgtaggaaaggtgcaaacgtcaaacaccgtggaaggagaaaaggatgggaagcccgaggggtgtccaagccctgtgagactgaaaaagcactttgaggaaccttaaagaccttgtttgtacataagaactgctagcaaaagagacctcactcttctcttgctttcgtgagaaaggaggggcgtggatgtaggattgctgtggaaagcgaacacaaaacaacccagaatgactgattaagtgccttgcaaatctttattattatccaaacatttatgttcatactttcttgtgtacagatggtgctagtcaagatgaaaacaacaaaacaaacaagaaaaacattttggaaatgtattcacagctctttttctcttggtgttttatcctatttctgacttgctgtttctaagtaagttgtgtttgtagagctatttcttaatcagtattgcttatgaataaatattacctgtcttttatggttattctggtgaggccactcaaacagagagacttccctcggcacgagccagtgtgtgtgtttccaaagtaggtttggagcagcaggtgacctcgatgccacatcccaacaagcagcgtggtcaggtagacccagaaggttgattgtggggcaggtgctttagagaacaggtgaggagacggcacctgcagcacaggggaggaggagtcctttgcgacctgggccctccctgctcctgggaggtgggccgtatgttctgtagaccgtttgcccccctcaagtcctccacacatgtggttccttgacccacaaatccacagtttgcgtggccctcaaaattcatattcatttttattccaaaaagtcttgaacgaaagctggaaccaattcaccagagccatatttctttctttagtattttctagtgttgtgttgtagattgattaaagtgggtttttccccagctgagagaccttctcaggcttgttcagagacttcaactgtattggattagaagaaggattcttgagactgtacatcttgtctgttgtccagagtacaaggatttcagctctcctgtgtcccaaagcctctatgccaagaagggacaggcttgtcctctcagtctttgctcctgcccaaaggcagagagagcttcccctccataactcacacgaccctggataggcagaacatagctgaagactatggatgtccaggtcttggctcccaacaactcaggacctcaaattcagatgttcctccctataacaattcccttaggaattatgatacccattttagtgattgatagaaacctggggtacagagtggtcaagggatttccctgataaaagctgtggtgctgatgatagtgcagcccagaatctaagagtccctgcagccttcgcatcgaggatggtacttaggcgtgtgcagagcacgcttcccttttgccctcaaatgcagcatatcttcatgagcctatttatttccaagctaggctgtctttattaaccaacaactcagccccagccactccccaagcggggaaaaaaacactacgtttcttggtcagtgtacctctggacactgcagcccacacagctggctgaactcggtaaatgggaaccgaagtcttgtgagcttcacatgacctgatcctttgttatcagaacagggttcaggtggccctgttggctcatgtgctttggaagccagctccctgggtcacgagtctggctttgcactttccataagagtctgcttctatgcaaaggtgcaaacaggagacatgcccaaatctgctggctgaacaggctaaactacagtgagaggctgctctggcatggctcgttcttccttctgtgtatctcccaagtctgacaagtgtgttgccctgggaagcaggacctccctgagctccttaaccttgaccccattctgcaggacagtcgcatgctctgggctcgcctctggcctcaaagcacttgtgtaagtgggcttgcttaacagtaatatccttggaggcttctggacccaaagggaagccaatccttcgagtttgccattgggctgctggttgctggtttcaaacatatagttcatgaaaagtctttaattggagattttcaaaggtgaatattctgtttttgttggaaagaaactcatctgatgagtcatcgatgagtttggctttcgcccctgccacatcctcccctgaggttccttccatgctgcactgccttcctttagccagtgacagagcctggtgcccttcctggactgaaaccgatggaatccttccgaggggagtggcattcggcttgcctcctgcctaaatctgcttttatccatttgtagcaactttatgctgtaacaaaaggcggaaggaaaccaagagttctcttagcaagtcagactccttcccaagatggcaatcacagaacacctcgcaggatctcgcaggccacggtgaaggagaatgctttatgttgatgttgtccattctctctctcttctctttgcttttttttgacctaaataagctgcaaacatgttaatttaccaatattgataaaccacatgaagaaatcaggcattttacgttatgatgtgcttgttcctgtctctgcctataaattgactgtattgatgatgaaggaaggagttccggctgaccattctgaagcagtcccagtcacgggaggatgccttacccagtggccagacatgatagttccaggtctccccttggttttggtgatagagaacccaaggaggcaagggggaatatcaacgaacccatttctatttcattacccacaagcgaaaggactagaaaaaaatatttgaaattaacatttagatgcataggtctaactccttgtgtgaacctgtcctcctcaccccctgctccaaatatgtgaggtggaagcattagcagcggagcaaaactaagatctaagaacgggcggtggtgctattgtgtccctgggagtcactccacgtcgcattgcacggtggtgctgaggagcgagagtttgctttatcatgggctttcagttcccacctgcgagctgcaaactttgatcttgttgtccttgaattcccctctacatcacgaggaagctgtctctttcatctcttccggatttggaatcagaacactctgcccgttgtttattcgccagttgccattcttaacatgggggagcattaagatgcaaatgcagagatgtgtcctgtcttgacaaaggtgggaacccctgagctggagaaggggctcctctcatgagaagctggggtaaacagccaggcatcgcagcgtggggaattagacaggcaggaatctggcctggtttgtcataaattagccttcaacttgaagtctattatgttcttataaggcggtagtgacttcagtccagccgcatctaccatccagggtggaggttcaaaaagtcttatacgcacctacaagtctcacgcttgctgctcagactttctgataaaatctcagagttctgtttgtattgaccaaaaatgcagttgtgcccacttgggtgtgtatctcatgtccttgtaaaccagccaccttctttggatagaaggcaaggctgacaaatctgcagatttgttcaatgcaaacacagccgtctatatcattggccactgctgattatattgagtgtttttaggttttttaggtttcttattccaaaaaggattttagactgtaaaatgactaaagatgagttaatttccaaactaaaaaaggaaggagtcctgcctgtactcattgttctttcctgctggactagtaacccattcttggagcacacacagagtccctcgcttctaaagacaatacgtcttaaaccctgaaaacttgccagtgagaaagaggttgaaagtcctgtttgctattagttgaggctaagccgtctgctgccactgtccctggggcctccatgctgccgccggggtatgtggcccagctgtccccccatgaaggacactcttcaatgccaccacacgggagtctgggcagggaggaaaggcacacagcccacttttctctgcaccaaatgaaacaaagctgggtgttcagtgtcactgatgcaagtaaatgggtctcaaattttggtgggggcagtgtttctttggattctgatacctctttttccacctccagaaagtatctgtcaacattggtgggtaacagcttataaagtgcatcacttagtaatcttcctgacaaaatgacacattttaaaattacaacctgttcattatttccatcataatgcaagcgtaattctaatccgggagaagatactgtcatttaagctcatcttctcaaaaaaattttttctgaaaattcctggaaactaatttatccctccctaaacaaacacattctgcttttgggtggccctacccagaacctgcagcaatgtcataacactggacacagtgcggcttggggcagtatcaagccttcattgcatacaaaccttaatctctaagcatagttgttcccaaggtccacacgtgtggaggcgagtactgaaataccacactcacacatctattccatgcgtacctagaaattaccttcaacactaaaaaaggttccttctttcattccctatcctgctaacagcccacattgtaatatttgatttatgaagaagttctaatttatttgtgaactcaggatgttgctttacagcattgctcgtgttctctcatttacttattatgcatcacggttggaaatgctatccacgtgccgtgcatcgaggtggagatttgctggatctgtctgtggctatttttttccatgtttttctcactcaagcaaagtctgttagtggaaacatgggctgggggatggggagaggacagataaagcaagagaatagggattagggtccaatcctcaatgcacagggcttagttcaaaatctaagctgtttctgtagtaagcagccaaatgggaaagatcccttcgttttgaatttgatgagaatgggcttggaaatccacgcccaccggcttgcacggaagaggactcagcctcttcctaatggttcaacattcaattcctgaggaaagtgctgatagtattagttccctacatttccctaagactcccatccaacccctagtgctactgaagagggtttgggaaagcaattggagttccttagcttggatatatatagtacctgtttttttcctctggaaaaaccaaagtactttagtgagtcttacaatcttaaggcattttgtcccctcactgggtcccgagaggcagggaggggctaggccttgagctaggagcaaggacatgggccgccaggcctggttgttactagctgtgcaaccttgggcgagcctcttcgctttgctgggcctcaggttcccgagtggaagactgggggtcagaacagctgcccttctgggagagcatcaagagaaagtggtataagtgatgggaagtgctttgaagaaattaaaggtctgtctaggagctgggggtaatcatttacagatgaagaaactgaagtctagtcattgactggcccgagttcacagagtggttttatagcaaaacagggacttgagtccagcttattggattcttcccatcagatcatattgcaccaggtatgtgtagacatgaacacataccattcctctaaggtgtgtgtacatacacggatgtgtgtgtacaggaggtacctgacatggtgaaaggccataggacagaaaacctgagttctaattccagctttgccagtcgtcccgtccgtgatatattccataggacagaaaacctgagttctaattccagctttgccagtcatcctgtccgtgatatattccataggacagaaaacctgagttctaattccagctttgccagtcgtcccgtccgtgatatattacctaactcctccagaactcagttttctaacctataaaatgaagacattgtgctagatgatctttgtggttccttcaagctctggatctctaattccatgattagtaatgtatgtatgtgtatataaatatgcttatctgtagaaatgggcccatttgaaaagtggagacaaggtctgcccaggtgcatttattgtgccagaaacagtgaattcctaaataagttcataaaatcttgttttacaattcaatggtagtgcttaatgttactgtctgaaatccactgtttaaccagatggaagactggggccattcaaaacattattagttcacaagtgtttgctgttaaaatgcttcaataaaactcatttgttaaagtcagaaattcaactcttctgtacttgggcaggtcccagcagccccttggcaggctagttttgtgcatgggcctttgcaagctatataaacgttaggtgttggcttgattatgataaatatgagcaggctccctggagaacagtccagaaaaaaagagttatagttctcacaaactggtgacatgaatccattaagctgtgtggcattttccagtgtaaagacattgtttgctggctacgatctctgactttttgtggcatatgaggtgtaaaatgttgtcaaaaaagaatctggtgtttaaaaaaaaatcaaactatggtggcattaaatgttcacttttattctacccagagttgtgaattcctctatccagcttctccttctgtacctcgggggaaagcaattcaagagctaggggtgggtgcttctcacggcagcaacaccttggcccaagtctagcccccaggcctctcaggacctcatgggatgaggcctgtctagtcgccctgtggagctggcccccaacaagttcagcagctcagccaggagtgagtagaggtgtcagctaagtcccagagtccctggacttgttctgcacacctgagagccagacgctggggaaagtgtggagaagcttgtgttgataatgggatattttctgttgccctccctcagtccagtgtttctggggcttacacaaaataagggaatttgcagtcactgtagattgctcgggcctggatgcatgggcctctgttacactggtgcttggtctcagttataactgggcacattcaggcaagaaggcaaaaacagatcagaactagaaaaaggtctctcagggtagccccttcccttgaggacagtctccctccactgcagacatttccctctgaacagtaatgagggactttcctagatgctggtgccacattcatccaatcaactgagtgctccacacccccaggagatagggcaggatggccactcaaagcaaatacatactcttcactcctggcaagatccctctctgagtccctgtctcctactgcaccacgcttgcctggacatgcacacctccaaggctccctgcttttcttctccccaaatcctagccaagaccttcttgggctccctttgggtaaaccgagcagaagccgtaagggttttctaaacataatgccttcaactagaagagaaggtagaggtggtgccaaactgatcattcccttggggaggagacgatggaaaggcagcctctattatagaattgtttctaatgccctcactcctcccaattaaagaccttctcagtgctctgctggcctgtcgtagcctataatacatcttgtcccaattcacatcagcacctctcgtctctgggaaggatatgtattgtgtggtcatcagaagtaacttttcattaggaaaaaaactatccaaatatacaatcttaggtggatctgtccctcaaaccattaaactatccaaactgttcttacttttattctttccatcctttttgatcctgtctctttgtctcagggaggacagtggccattctgcctaccttggcaccatgctgcatttggccagacgcccctgggactagaaggtcatagaaaagaaagcaaggtgatgtcattgtccagcaatggcagatcaggctatggctgcacctggatggagaaaatgcctccgcatctatgcaggacctgttgcagtgtctgatgcttccacttgtttttctagctgaaggtgttgtttctagaaaacccttataaatctacagagcacttggagtgtaaatgcattgacctgccagtggctgcagtgctcctaacacccatggatatctcttgttctataactccagtggctagaacagaacatggaacatagtgggtgctcaaccaatattagctgaatgaatgaatcaatcaattattcaactttgggggaagaggcaacaacaaaaacctgggcaggggcctgcagcatttcagagtcccgtgacaagtggaccaaaggtctgcatttgcaaacccctactgggattaatccctaattcccagtggagaaggagcaccaggcccacacaaggccagacccacgccctgggcttcttacgcacacagccttgacctccacagccacggagcagccttggctttcaggcctcctaaagcatgtttctaagagatgaaaaagagtcgtgttcaagctcgtggattccgtctcaacatgtataaaacaatcgtcgagcaaaccctcactgagcagcactcgcactgtcccagacaccgtgctggttgcagtgaatgaaacaggttccaggctcccagaactcagtgaggttggcgagccgggccggcacacagaaacgctgctacaaacacgcaaacgtgctcccctccatgcagggcaaaccctcctcaggggccccttttcctagaatttgggcccttgtccaggcctcacctccagaagagtctccttaagcaggaggctgagagggcagcgaggcggggagggaagggggacagccagtgtcactgcaagtcgctttatttctcctgcggaagtccagccctccctcactcccctactccccggcacttccagcttcctccccgcagcgggttaacacgtgcatttgccaagagctcaggaagggcgcgctgtgagcatccagccagctgaggaggaggggactgtcccctgggcagccaccccgctgccacctgaggaagctactttggggtccacctgcatgcacggtaagcagcacgtcctttctttttcattttaaaattgttacattgccccgctcagcccatcctctgtgctctcccctctccagcaggttctggggtgctgatacatattacacaccttttgtgtgctcagaagaaaaactcaaaaaaaagagctttatagaccacaaagatctacaaacccccaaagtccctgatggcccagtgagagaaaggccgctgctttttaaaactgcactttgaaaatatggaaattgaaaataaaaaattaccttcatctcaccccagagagaaccactgttatttaatagatacacacacacacacacacacacacacacacacacacacacacacacagaggcacgtgcgctattacaaattttggattatcctggatatggtccttttggaacccttttcccctttaataatcctaccatgtatatttgtttccccaattggcacatgtgctctgacaacatggcttttaacattgcagaatattccatcacatagatcgaccgactctcatttatgcacggctactattccctgctcttggaccataagattgcttccactttttcacaattatcagttacactgttgaacataaatcaacacatattgaatataaatcttttttgttaacctgacaagtccgtagggataaattcctggaagtaaaatagctataacaagaggaataaaagattacaaggcatgttacacacattgagggtggctgtgctttaaaccgtccaacctcaatgatgattagaagccttccctgatagccccagatggagtcatctcttcctctcttaacttttatttcattgattcacttatttattcattctacaaatatacattaaaaaactctggccaggcacggtagctcacgcctgtaatcccagcactttgagaggccgaggcggggggatcacttgaggtcaggagttctagaccagcctggccaacgtggtgaaaccccctctctacaaaaaatacaaaaattagctaggcatgatggcgcgtgccggtaatcccagctacttgggaggctgaggcacaaaaattgcttgaacccgggaggtggatattgcagtgagccgagattgcaccactgcactacaccctgggcaaagagcaagactaagtctcaaacaaacaaacaaacaaacaaaaaaaaaaaactccaacatgggacagtgttcctgttgtaagatgtgccaagttcttagtatacacttcatcatattttaaagtaggacgtgtttatctgtccttaaatattaggcatcaggctcacgcctgtaatcccggcactttgggaggccgaggtgggcagatcacaaggtcaggagattgagaccatcctggctaacacagtgaaaccccgtctctactaaaaatacaaaaacttagctgggtgtggtggcgggtgcctgtagtcccagctacttggaggctgagggaggagaatggcgtgaacccaggaggcggagcttgcagtgagccgagatcgcaccactgcactccagcctgggcgacagagcaagactctatctcaaaaaataaaaaataaaaaataaatttaaaaaaataggcatcaggagggtaggagctctttttatggctccctgtgtttaacacaatgctgggcacaaaatcaggttaagattcagagggtttcgacagccaaagctattgaagggaatggcattttatacacagtatagatatccatacactggaaacacttttctggggattctgacatccatctcagcccttgctgagaactcttagctgaggggccatgaagcctgggtgctcgtgtgaaactgcaacttgcagttgactttgagggagtctcagtgcgtctccaggctccatctcctcatctgtgtaagagaagtgaagcccaatctgtcctgcctagtttcccctgggtttgttctgaggatgaaagaagatgctgtgtgtagaaccaggtcataatctggtaagtgctcaacagacgtaaggtcctgggataacatacacttgttttgataattacaacaagattcctcaggcagcctttacttctttcctagactgtgcccgctacacagtttcttcattcagcacctgcctcattctctcatgttgttttttggagacagggtcttgctctgttgcccagactagagtgcagtggcacaatcatagctcactgcagtctcaaactcctgggctccagcgatcctcctgcctcagcctcacaggtagctgggactacaggcacgaaccaccacacctctctaattttttaaaaaaatttttggtagagatggggtcttgctatgttgcccaggctggtctcaaactcatggcctcaagcaatcatccctccttggcctcctgaaaggctggaaagccactgcatctagccctattcattttctttctttccgagacagagtctctctctgttgcccaggctggagtgcagtggcacaatcttggctcactgcagcctctgcctcctggattcaagtgattcttgtgcctcagcctcctgagtagctgggatttcaggcaaccatcaccatgcccagctaatttttatattttttgtagagatggggtttagccatgttggccagactggtcttaaactcctgacctcaggtgatccacccagctcctaaagtgctgggattacaggtgtgagccaccacgcctggccccattcttttaaaaatatcagtggcttccatctattagaagtaggttgggctatacatcacactatccctaaatcttactttcatgtggtttgtttaataattaattcccaataagtctcaggggagagttctgcaatatgtataaaactttggcaagatggcatattaggaacagctctggtctgcagctcccagcgagatcgacacagaaggcgggtgatttctgcatttccgactgagggaaattgatattagggctaatatcaagaatctacaaagaacttaaacaaaattacaagaaaaaaacaaacaactccatctactgccttgagtgggcagtaggcaagctgaggcctgggtttctaagtggtcgagaggaggctggagaccagcaggggtcagacgctgagacgagacagatttaaccctcatcacaattttgctcaagtcctggggttcctgccccaccagtttccttttcggaagcctgaaaacataaaccaggtttaccaacaccctcaattcgcaaccagccccttctctccggtggatgtgtttgggaagccaggcatagagaatattgccattgacctcctcctgctcctttccttgtcccgctttattagcatcacatgaatttgatgggtgtgttgccgaagccagaataagtagtttagacggtgagggcagcagcagctcagagaagggagcagctgaaaaacctcagggcttgtgcaccacctcttgaggccagccagccttgccctgtctccaggcagctgtgctcctaaaccgcgacaaatgactaagaaatttctgctcaggggagtcctgagggaaggaaggtgctctttccctgcaggtgcatttgacgtcactcaggcacagggggcccctcccagcagcctccagaagcagcctccagagcctgggtcggtgacagcccgtctagtatttaagcatgattcagccaccctccctactcccgtgtaaatccgtggatatgcacggaatccagcttcctctttctgcacatacacacatccttttggctatttctctggaggaccctgactaacacaggccaccgaccctccatcactgtgggcttcctgtttctgcagtaagcactccctttgggagagtccaatgagaaaaaaggaaagaacctcattaggtccctccacgtcaacactgactgtgttaaccctaattactgcacctgaattattcttttccagttgcaaagaaggaaatctctaaggtcttttttaaaacctacaaaacttctaaagaatggtaaaatgggaaggcttttttgcattggcaggagcataaataattcctgagggcatctgaactccaaccaggtcagcccagcccagcttccccaacatcccccttgccagggaagaggcagagaatagtaactcaagtttatagagactgtattgttgcctttgatcttcagcaccaccccattgaggtaagcattagctcatacctttggacaagggcaagtcagaaagtgagagggaaagtgagaaaggcatttggaaaaaacagggaggaggacttggtcattgcttcattcatgtattcattgcacaaatatttattggctaccacaatgtgtcagctgtggtgctggaagtggagagacaatagcaagtgagacagagaaggtccaaacctttacccaacggagtgtatagtccagcaaacatttcctgaaggcctgcacctggcaaggcactgctggcaaagcccaagagtacagcaacccagcttaaaggagggtgatccaactttgaaagctgccccttctgtgagcgccctcaatccctcaagcttattctgcctcactaatgattgctctcccttccatggtctattgtaccatctttctctccctattggcctgagagctcttccagggcaggaccactctccactcagcccaacacaatgtctggcgcacggttcttcaggcacattcatccaatgatgacctgcaatgagccgagcatggtgtcagcagctgaagcaacagagagggaagaaacccaggccccttcctccagggatgtggagtctagtgggggagaaagataaagaaagaagcaactattttgatgtgataaatttcctggggaatgactaagtgccaagctgtgcagaagaagaaatgctggctgggcctggtggttcacacttgtaatcccagcactttgggaagccaaggtgggaggattgatggaggccaggagtttgagatcagcctgagcaacagagcaagactccatctctacacaaaattttaaaaattagccagctgtggtggcacacaactgtagtcccagcaacttgggaggctgatatgggaggattgcttgagccccggagttcctggctgcagaatggccactgccctccagcctgggcaacacagtgagacctagtctcaaaaaaaaaaaaaaaaaaaaaaaaaaaagccaaaaaggagagaggagggaggagagaaaagaggagggaggaaggggaggtcaaggaaggaggaggaggaacatagctgtaatgggaagatagggaggaaaaaggaggatggaagacatgctcagatatgtcttcatggctagatggtaagttctgactgggcagagacaatgtctgtttccttagtacctagcaaagggtcttgcactgggtagatattcactgtattttcagtggggaatgaattcccataatagggaatctgaagcccttaaagaaaaccagaatagcaaagaatagaataatgtttactcttttatattgattagaaatgcatactccacatatagaaagtacaaactcaacagagtaaaatctcagagaatggtttttacacatatttgcagtgtgatcagtcaatgttcctgaaagctaataagaatccagtaaccatttaatattaaatgtatggagaagctacctaaatcctagggtcatgttgcttgtcacttgagagaacaccattttcttgtctaactcttatttttattcacattcatgatcatacatgcatgtgcagccacacgaacatcaacatcaatatctggtttctagagtagattctcaaaaggtaggaaaacctgccttgatagcatcttataaaactcagcacattaccacacacagatgcattccaattgtgaaatctctcaggacgaaaagtattctatgggtgatgctgtttttcttttttttcccaggttttgcttattaatgacccagccaggctttctcacattgtcttgtgctagaggcattgactcctcacatcggaaaagtaaaatgcctagaaatgcctaaaggagaaataaaacaaagtggttgatgcttagaaagaaaagtcatccaattcactcacagtgggtcatgctgcttaactcagccacaaggaaatcccaattcatgcaaaaataattctgtcttcattattctacaatccagtgggtgtctatgataatttgagtactcctttcttgaaaagagaagatcagcacgtgtgtctttaacaatacattcctcttggtcttgctgaaatgctgcattagtgactgcatctgattgcactggaacctggctcaggccccctactgatgctcttacaggccattattaatgcgtaccccttcaggggctgtaatttgggactcaatttgccataaaattgtcctaagtgtcaccttagtaatcggagatcacatgacccatgaaacacattgagatgaaagatggcacctcttggaaatgaatgtcaaattttcccccatagtaaaaaggcactagccattgtatttgcagtggatttcactgtgccttgagatggggaggggttacaatgttccctgtgcacatgccttgagctgggcctgctaggcctcagaccagagccttcacctaccacataccctgaagactcaacacacagactctagtaattcagccatccctcaggtggattttgatggtgcttatctttttaaccaaaaatccatatgttttctaacaaaggagttttatcctaattccagatacaaaaagtaggttagatgtcaagtctggcaaaacaaaaggtagtttgattaatcattagggaaatgccaatcaaaaccacaatgagacacaatttcacacctatcaggatggctatttccaaaacaaacaaacaaacaaacaaacaaacacaaaacagaaaatcacaacggttgacaaggatgtggagaacctggaagccttgcacgtggctagtgggaaggtaaaatggtgcagctggcgtagaaaaacagtatggcagctcctcaaaaaaaggaaacccaggatcactattaacatgtgatccagcaacttcacctctgagtacacaacccaaagaaccgaaggcagggacttgaatagatacctgtgtatcagtgttcatagcaacactattcacaatagccaaatgacagtaataatgatctacatgtctactggcagatgaatggataaacaaaagcggatacagacataccatagagtgtcattgagtcttagaaaggaatgaaattctgacacatgctgaacatttgcccatggatgaaccctgaagacatgatgctaagtgaaatcaaccagacagagagagacaaataacgtgtgattccacttatacaagatgcggagagtagtcaaattcacagagacagaaagtggagtggtggttcccacggtggagcaggggtcattgttcaatagtatatagtttcagtttgggaagatgaaaacatctgaaaaatggatggtggtgacggctgaagaacaatgcgaatgtacttaatgccactgagctttctattttaaaatggttagaatggtaaagcatacattatgtaccttttataacaaaatgttttaaggtagattggttgtcaaaatactagaatttcacatttcaatggacgaaagccaaaacgaatgcaatgtgggactgccctggaaaactccaggcatttggacggccatcttgaaactgtgctgtagataaggtagatcaagaccaggaagccctggggagaaggtggcagggatatagagctggagagaaggggaactgtctgcctctttccttcagaaaagcctgcggtgacaacttgttcacctctagccttactgctcgggctgcagaggacgccggcaccagcacctttgtccatctcaagggctctgttggaaacttgagtcaaatcaactaccttgcagccttaatctatagtagttatttttgttgttccttctgttcctggtgacacttggttctgaatttagtctagcagaatgagagggcctgcacaggggccctgctataagttaccttcactcacaaaatgcgggcatccccacccctagttacaacacacatgtagcaacatgtcttcgtatgttctaaagcagaggaaagagccaatggaacttataagctgtagcttataaagcactcttagatgattctaccattttttaaaaaaaattaccatgatttatctggtcatctagaggggccagacacagtatgattatgatgctcttatgaacttcagagcactcctagaggccacttttaatgaagtacaagcctcctgactggagattaagtcaatatcctttatcacactattgaaagcactgaatattttggtatcgactctcactactctatttcaaaagaggctgaagaagctgaaaagctgagcagcacttctcagtttcaagaaactaggaggcaaaaactggagtctaggactcatcaatgagggcctaataattccctccattttggggctgagatctcaaagaactgtaccctaggactaagggtgatggaagtcgactaaaactcagcaacaaattatctcaattcatgaagtggaattaaggtgatcaagactgctagtctgggggaggggtggagcaaaatggctgactacaaggctccactgattgtccccacagcaggaatgccaaattcaacagctatccacataaagacagcatctttataaaaccaacaatcaggtgagcactcacagtccctggttttaattctatcactgaaagaggcaccaaggaaggtagcaaggagagtcctgaattgccagtgccccacttcctccatcgcccaacagcggccatgtggcacagagcaagaacctgtgcactcaggagagacagcacagtgattatgagactttacactgaactcagcactgccctgtcacagtagaaagcaaaaccagactgaactcaactgatgaacgcccagggagggagcattcagatgggcccaagctggaggggaaccgctgtccccgtggggggaatctgagttccagcaagcctcaccaccatgggctaaagtgctctggggccataaataaacctaaaaggcagtctataccacaaggactgtaactcttaggcaagtcctagtgctgagctgggctcgaagccagtgggcttggggagcatgcgacctactgagacaccacccaacacagctaaaggagtgtttgcaccagtccttccccaaccccaggcagcacagctcttggctccaaaagagatccctccattctgcttgaggagaggggagggaagagtaaagagtaaagagaactttgtcttacatcttgggtaccagctcacccaaagtaggatagggcactagtcagagttgtgaagtccccatttcaggtccttcctcctggatgacatttccagacacacccagggccaaaagggaacccactgctttgaaaggaaggacccagtgctatcaggatccatcacctgctggctaaagagctcctgggtcctgaataaccagcagcaatatccaagtaatatccaggtggtggtagccatgggctgcctgtggaaacgggacgaaagagtgggaagagctgggactcatggtttgagtgccagctcagctgcagtagaatagaacaccaggtatatttctaaggattttggttccagtacgtggctcctggacagcacctctggacctgcccagggcctaagggaacccaatgccctgaagagaaggacacatgcctggttggcttcaccacctgcttactgtaaagccccagggcctcgagcaaatataggccatagccaggtagtgcttctagcaggccttgggtgaaactcactactgtgctggcttcaggtctgaccagtgcagccccagtgatagtggccacaggggagcttgtgtcacctcacacccaactccaggtagctcagcacagagagagagactatgtttgtttgggagaaagtaagggaagagaacaagaatctttgcttggtatccagagaacgcttgcagatcttatccaagaccacaaaggtggtacctctatgagtctgcaagaaccacagtgttaccaggcttggggtgccttgtaatacaaacatgacttagataacacacccaagtcctttcaaatacctcaaaagccttcccaagaagaacaggcacaaacagcccagattgcaaagactataagtacctaactcttcaatgcccagacaccaaagaacatccacaagcatcaaaaccattcaggaaaatgtggcctcaccaaatgaactaaatcaggcatcagggaacaatcccagagaaacagagatatgcaacttttcagacagagaattcaaaacagccattttgaggaaactctgagaaattcaagataacacagaaatggaattcagaattctatcacataaattgaacaaagagattaaaataattaaaaagaatcaagcagaaattctggagctgaaattgcaaatgacatactgaagaatgcatccgttattggccttaaagaggaggtagagaaggagatagggatagaaagtttattcaaagggttaacagagaacacctcaaacccagaagatatcaatatctaagtaaaagaaggctacagaacaccaagcagatttaactcaaagaagactacctcgaagcatttaaaaatcaaactcccaaaggtcaacaataaagaaaagatcctaaaagcagcaaaataaaagaaacaaataacccattggagtttcaatatagctagcagccgacttctcagtggagaactgatagtcgagaagagcatatttaaagtgctgaaggaaaaaaacttttaccctagaatagaatatctatcgaaaatatccttcatacatgaaggaagaatactttctcagataaacaaaggctgagggatttcaacaaagactagaactgtcctacaagaaatgttaaaggaagtatttcaatcagaaagaaaaggatgttaatgagcaataagaaatcatctgaaaatacaaaacttactggtaatagtaagcacacagaaaaacacagaatattaaacattgtaactctggcttgtaaactactcttaccttgagtagaaaagactaaaagatgaactaataaaaaataataactacaactattcaagacatagacaatacaataatacatacatttaaaagttaaaaatatataaatttaatatataaatttaaaaagttaaaaaacacgggatgaaattaaagtgtagttaacctaaccattattaggattttttgcttctttgtttatgcaagcagtcttaaaataatgggtaatagatattatttgtaagcctaatggtaacctcaaatcaaaaaacatacaatggatatgccaaaaataaaaagcaagaaattaaatcctaccaccagagaaaatcactttcactaaaagaaagacaggaaggaaggaaataagaaggagaagaccacaaaataaccattgcattgggcctgcctgggtggtccgtgcaacccaagagagtgaggaaaagcagggtggggcaacagcccacccttgagcggggtggaaccaggtgagccctcaccccaggcaagaaaggtggtgagtgattgtacaacgcccccccaggaagccatgcttttcccatggatctttgcaacccgcagatcaggagatccccttgtgcacccagcaaggccttggttcccaagcacagagctgtgtgaactctcgcagctgcttggccatgcacaaagacccaggagtttcttgcatactccaccccgggaattccagtgagacaggagatcttccaagctttcccctaggaagggggctaaagccaggacactaagcagcgtcatcctgcaggccccactcccatagcacctcacgagttaaaacccactgacttggaattctagccagcctgtgggagcaggctggagattgccggagatgaccaagttcccagggggaggggcagccgccatctacatggctcaagtcagccattttggcctgccaactccaggagtctgcaaggtccagaccaaaaggaattcagcgccatgccgcgcagccagctgctgtggtagatcgcggccaggctgcttctttaagtgggaccctgacccatccctcctcactgggtggggcctccctgtgggaatttcataactccgatctctccctgggatggagccactgtggggaggggcggccaccgtatctatggttcagcctgctggctctggaaagtccaggtgatctggaaaagaggggctcctcccactgcagcacacctgctctgccaaggggcagccagactgcttctttaaatgggtcccattcctcctgactgggtaagacctcccaataggggtctccagacaccttctagaggagcatttgggccagcatcaggtcgggacccctgggatggagctcccagaggaaggagcaggctgtcatatttgctgttttgcagccttcactggtgatacctctaggtgcaggagggtccaaggcaactagggtctggagtggacctccagcaaaccacagtagccctacaaaaaggggcctattaaaagaaaaacaaacagaaagaaaaacaacaacagcacagaccccataaaaacccattaaaacgttagcaaacccaaagatcaaaagtagataagtccacaaagatgagaaagaatcaacacaaagatgttaaaaactcaaaaagccagagtgtttcttctccttcaaatgatggcagcatctgtccagccaggccacagaactgggctgagactgagatggatacattgccagaagcaggcttcagaaggtgggtaatagcaaacttcactgagccaaaggaccgtgttctaacccagtgcgaaacagagaagaatcatgataaaacattacaggagctgataaccagaataaccagtttagggaagaacagaaatgacctgatgcagctgaaaaccacaacacaagaacttcacaataatgcaatcacaagtatcaacagccaaacagaccaagcgggagaagaatctcagagcttgaaaactatctggctgaattaagataaacaaacaagaatagaggaaaaaaaaaaggaacaaacaaaacctccgagaaatgtgggattatgtaaaaagaccgaacctatgactaattggggtagctgaaagagatggggaaaatgaaaccaagttggaaaacatacttcaggatatcatccagaacttccccaacctagaaagacaggccaacattcaaattcaggaaatgcagagaaccccagtaagacattccatgagaagatcaaccctaagacacataatcatcagattctccaaggttgaaatgaaagacaaaatgttaagggcagccagagataaagaccaggtcacttacaaatggaagcccatcagactcatagcagacctcttagtggaaaccccacaagccagagatttgggggcaatattcaacattcttaaagaatttccaacccagaatttcataactggacaaactaagcttcataaccaaaggagaaagaagatccttttcagataagcaaacgctgagagaattcaacaccaccagggtgccttgcaagagttcctgaaggaagcactgaatatggaaagaaaaaccattatcagccactacaaaaatacactaaagtacacagaccagtgacactacgaagcagctatataaacaagtctgcaaaaataaccagctagcatcatgatgacaggatcaaattcacacataacagtattaaccttaaatgtaaacaggctaaatgccccaattaaaagacacagaatggcaagctggataaagaatcaagccctatcagtgtgccgtattcaagagatacatctcatatgcaaagacacacacacgctcaaaataaagggatgaaggaaattttaccaagcaaatggaaaacaggaaaaagcagggagagcaaatctggttccagcaaaacagagattaaaccaacaaaaaatcaaaaaagacaaagaaggccgggcacagtggcttatgtctgtaaccctagcactttgggaggccaaggctggtgggtaacttgaaatcaggagtgtgagatcatcctggccaacgtggcaaaagcccgtctgtaataaaaatacaaaaattagcagggcgtggcagtgcacacctgtaatcccagctacttgggaggctgaggcacaagaattgcttgaacccaggaggtaaagactgcagtgaggcaagatcgcaccactgaactccagcctgggtggcaaagactctgtctcaaaaaacaaacaaaccaacaaacaaacaaaaaacaaagaagggcattacatgatggtaaagggttcaattcaccaagaagagctaactatcctaaatacatatgcacccaatatatatatatgcatctaatacaagagcacccaaattcataaagccagttcttagagacctaccaagagacttagactcccacacaataacagtgggagactttaacaccccactgtcaatattagacagatcaatgagacagaaaattaacaaagctattcaggacctgcactcagctctgggtcaagtgtacctgatagatatctacagaactctccacccaaaaacagcagcatatacattcttctcattgccacgtggctcttgctccaaaatcatcacataattggaagtaaaacactcctcggcaaacacaaaataactgaaatcttaacaaacaatctctcagaccacagcacaatcaaattagaactcaagattaagaaactcacccacaaccacacaaatacatggaaattgaacaacctgctcttgaatggcccctgggtaaacaatgaaattaaggcagaaatcaagaagttctttgaagctaatgagaacaaagagacaacataccagaatctctgagatgcagctaaagcagtgctaagagggaaatttatggcactaaatgccctcaaaaagctagaaagatttcaaatacacaacctaacatcacaacgaaaagaactagagaaccaagagcaaacaaaccccaaagcaggcagaagacaagaaataaccaagatcagaagggaactgaaggagatagagacacacacacaaaaaaaacttcaaaaaaaatcaatgaatctgagttggttttttgaaaaaaataaaatagaccactagctagactaataaagaagaaaagagagacgaaccaaatagatacagtcagaaaggataagggggatatcaccactgatcccacagaaatacaaacaaccatcagagaatactataaatacctatatatacataaactagaaaatctaggagaaatggataaattcctggacacatataccctcccaagactgaaccagaaagaaattgaatccctgaatagaccaacagtgagttctaaaattgaggcagtaataaatagcctaccaaccaaaactagcccaggaccatacagatttatagctgaattctacgagaggtacaaagaggagctggtaccatttctactgaaactattccaaacaattgaaaaggagggactcctccctaactcattttatgaggccagcatcattctaataccaaaacctggcagaggtccaaaaaaaaaaaaaaaaaaaaaaaagaaaacttcaggctgggtgtagtggctcacacctgtaatcccagcactttgggaggctgaggcgggtggatcacctgaggtcaggagttcgagatcactctggccaacaagtgaaaccccatctctactaaaactacaaaaaattagctgggcatggaggtaggcacctgtaatcccagctactgggaaggctgaggcaggagaatcgcttgaacccaggaggcagaggttgcagtgagctgagattgtgccattgcactccagcctgggcaacgagagcaaaactctgtcacaaaaaaaaaaaaaaaaaaaagaaaaagaaagaaagaaagaagaaagaaaagaaaaaagaaaacgtcaggtcgctatccctgatgaacatcaatgcaaaaatcctcaataaaatactggcaaaccaaatccagcagcacatcaaaaagtttatccaccacagtcaagtaggcttcatctctgtgatgcaaggttggttcaacacacacaaatcagtaaatgtaattcatcacacaaacagaactaaaaacaaaaaccacatggttatctcaatagatgcagacaaggcctttgacaaaagtaaacatcgcttcatgttaaaaactctcaataactaagtattgaaggaacatacttcaaaataataagagccatatatgacaaacccacagccaatgtcatactaaatgggcaaaagctggaagcattctccttgaaaatcagcacaagacaggatgccctctctcaactactcctattcaacatagtattggaagttctggccagagcaatcagacaagagaaaaaaataaaaggtattcaagaaggaagagaggaagtcagatagtctttgtttgcagatggcatgatcctatatctagaaaaccccactgtctcagcctaaaagtttcttaagctgataagcaacttcagcaaattctcaggatacaaaatcaatgtgcaaaaatcacacgcactcctatacaccaacaacaggcatgcagagaaccaactcatgaatgaactcccattcacaattgctacaaacagaataaaatgcctggcaatacagttaacaagggaagtgaaggaactcttcaaggagaactacaaaccactgctcagggaaatcagaaactacataaacaaatggaaaaacattccatgctcatggataggaagaatcagtatcatgaaaatgaccatactgcccaaagtaatttacagattcagtgctattcccattaaactaccactgatattcttcacagaattagaaaactatgttaacattcatatggaactaaaaaagagcctgtatagccaagacaatcctaagcgaaaagaacaaagctggaggcatcacactacccaacttcaaactatactacaaggctacagtaatcaaaacagcatggtactagtaaaaaacagacacatagaccaatgaaacagaatagagaattcagaaataagaccgttcacctacaaccatctgatctttgataaacctgacaaaaattaactcaagatgtattaaagacttaaatgtaaaacctcaaacaataaaaaccctagaagagtatctaggcaataccattcaggacataggcacaggcaaagatttcatgacaaaaacaccaaaagcaattgcaacagaagcaaaaattgacaaataggacctaattaaactaaagagcttctgcacagcaaaagaaactatcatcagagtgaacagacaacttacagaaagggagaaaatttttgcaatctagccatctgacaaaggtctacaaggaatttaagagtctaaaaggtcttaaacaagtcttaaaagtctacaaggaacttaaacaaatttacaagaaaaaaccaaaaaacccctttaaaaagtgggcaaaggatatgaacagacacttctcaaaagaagacattcatgcagccaacaaacatatgaaaaaaagctcagcgtcagtgatcattagagaaatgcaaatcaaaacaacaatgagatactagttcatgtcagtcagaatggcaagtattaaaaagtcaagaaacaacagaggctggcaagcatgtgaagagaaaggaatacttttacactgttggtgggaacgtaaattagtttaaccattgtggaaaatactgtggcaactcctcagagatccagaagcagaaataccatttgacccagcaatcccaatactgggtatatgcccaaaggaatagaaatcattctgtcataaagatatatgcacatgtatgttcattgcagcactattcacaatagtaaggacatggaatcaacccaaatgcccattaacaatagaccagacaaggaaaatatggtacatatatgccatggaatactatctaaccataaaaaggaatgagatcatgtcctttgcagggccatgggtggagctggaagtcattatccctcagcaaactaacacaggaatagaaaaccaaacattgcatgttctcacttataagtgggaactgaataatgagaacacacggacacatggtgggggagaacaacacactttgggacctgttgaggggttagggggagggagagcatcaggaagaataactaatgaatgctgagcttaatacctaggtgatgggttgatctgtgcagcaaaccatgatggcacacgtttacccatgtaacaaacctgcacatactgcacacgtaccccagaacttaaaacaaatgttgatgaaaaaaaaatgacagaatggctgaattgattaaaaaaagacccaatgttctgttgcctaccagaaacacacttcgcctgtaaagacacatacagatagaaaataaagggatggataaagatattctatgcggatggaaaccaaaaagggacatgagtagctatacttacatcagacaaaacagatttcaagtcaaaaactacaaagagagataaagaagatcattatataatgattaaaggatcaatttggcaagagaatataacgactgtaaatattacatgcacccaacattggagcacacagatatatacagcaaatatcactagagctacagggagagagatagaccctaatacaataatacatggagacttcagtacctcacttttagcattggacagatcttcctgacagaaaatcaacaaagaaatatcagacttaatctgcactacagaccacatgaacctcaaagatatttgaagactatttcatccaatggctgcagaactcacattcttttcctcagcacgtggatcattcttaaagacagaccacatgttagatcgccaagccagtcttaaaacattccaaaaagctgaacaaatatcaagtatcttctttgaccacaataaactagaaatcaataacaagaggaattttggaaactacacaaacacatggaaattaaacaatatgctcctgaatgatcagtgggtaaatggagaaactaagaaggaaattgaaaaatttcttgaaacaaataaaaatggaaacacaacatactaaaacctatgggatacagtgaaagcagtactaagagggaaatttatagctataagtgcctatgtcaaaaaagaagaaaaacttcaaataaacgacataacaatgtatcttaaataaacaacataacaacgtatcttaaataacttggctttggtttgcttttgcaaaattagtagaaaaaaaagaaagattagagcagaaataaataaaactgaaataaagaaaatacaaaagatcagtgagacaaaaagctggttatttgaaaagataaacaaaatgacaaacctttagccagactaaagaaaaaagggagaagatccaaataaataaaatcagacatgaaaacagagacattacaaccaataccacagaaattcaaaggataattggtggctcctataagaaactatatgcaaataaattggaaaatctagaagacatgaataaattcctagccacataaaacctaccaagattgaactgtgaagaaatcccaaacctgaacagaccaataacaagtaatgacattgaagctgtaataaatagtctcccacaaagaaaagcccaggacccaatggctgaactgctcaattttaccaaacacttaaagaactaatatcaatcttactcaagctgattcaaaaaaggtgaaggagggaatacttccaaattcattctacaaagccaatattaccctcatactgaaaccaaagacacatcaaaaaaaagaaaactacaggccaatatcactgatgaatattgatgtaaaaatccttagcaaaatactagcaaaccaaattcaacaatacattaaaaagatcattcatcattaacaagtgagatttattcctgggatgcaaggatggttcaacacatgcaaatcgatcaatgtgatacatcatatcaacagaatgaagcacaaaaatcatatgattatttcaattgatgctgaaaaagcatctgataaaattcaacatcccttcaggataaaaaccctaaaaaatggctatagaagaaacataccttgacataataaaagccatatatgacagaccaatagctagtatcctaatgaatgaggaaaaactgaaagcctttcctctaagatctggaacatgacaatgatgcccaatttcaccactgttattcaacatagtactggaagtcctagctacagcaatcagacaagagaaagaaataaagggcatccaaattggaaaggaagaagtcaatttatccttgtttgcagatgacatgatcttatcatatttggaaaaacctaaagactccactgaaaaactattagaactgataaacaaattcagggaagtttcaggatacaaaaccaacatacaaaaattagtagcatttctatatgccaacagtgaacaatctgaaaaagaaatcaataaagaattccgtttacaatagccatacataaaattaaatacctagaaattaacttaaccaagtaagttaaagatctccacaatgaaatctataaaacaatgatgcaagaaattgaagaggaaacaaagaaatgtaaagatattccatattcatggattggaataatcaatattgttaaaatgtccatactactcaagacaatctgcagatttaacacaatccctattcaaaataccaatgacattcttcacagaaatagaagaaataatactaaaatttataaggaactacagaagacctagaattgccaaagctatcctaagcaaaaataacaaaactggaggaatcacattaacctgacttcaaattacactacagagctatagtaaccaaatagcacagcactggcataaaaacagacacatagagcagtagaaaagaatagaaaatatagaaataaacccatatatttgtagtgaactcattttgacaaaggtgccaagagcacatattggggaaaggacagtctcttcaataaacggtgctgggaaaactggatatctgtatgcagaagaatgaaactagacctctttctcttgccatttacaaaaatcaaatcaaatcaaaatggattaaacacttaaacctcagacctcaaactatgaacttccacaagaaaacattggggaaactctccaggacattggactggacaaagatttcttgaggaacactctaccagcataagcaaccaaagcaaaaatggacaaattggagggcatcaagttagaagcgtttgcacagaaaaagaaataatcaactaagtgaagagactatgggagaaaatatttgcaaacgatccatctgacgaaggaataataaccagaatatataagaagctcaaacaactctataggaacaaaatttaataatccaagtaaaaaatgggcaaaaagatctgaatagacttttctcaaaggaagacatacaaatggcaaacaggtaaatgaaaaggcactcaacattactgatcttcagagaaatgcaaatcaaaactataatgagctatcatttcaccccagttaaaaccacttttatccaaaagacagacaataataaatgctgacaaggatgtggagaaaagggtattctcatacagttggtagaaatataaattaatataactactatggaggatagtttgaagattcctcaagaaaccaaaagtaagctaccatatgatccaccagtcccactgctggatatatacagccccccaaaatgaaatcactatattgaagagatatatacactcccacatttattgcagcactaatcacaacagccaagctttggaagcaacctaagtgtccatcaacaggcaaatggataaagaaaatgtgttaaatacatatatacaatggaatattattcagccataaaaaagaatgagatcctgtcatttgcaacaacatagatggagctggaggtcattatgttaagtgaaataagttaggcacagaaacacaaactgccatgttctcacttatttgtgggagctaaaatttaaaacaattgaactgatatagatagagaataaaatgatggtttccagagacagagagggcagtcaggcagtggtagtgggtaagcagagatagctaacggatacagaaaaagaaagaataagacctagtatttgctagcacagcagtgtgattatagtaaaaaacaatttaattttatattttaaaataaccgaaagagtataattgaatcgtttgtaacacaaggagaaaagcttgaggtgatagacacccccatttaaccagatgtgattattgtgtattgcatgcctgtatcaagatatctcatgtaacccataactatatatacctactatgtgcccacaaatttaaaaataaaaaatttttttaaaggattgctactttgactagccacatgccagaaacaaatataaatcttatctggaagatgataacatttttctatgtctaaattatgtcagtaactttttatatacaatgtttaatactcaattaaaacataagcatagaaagagacaaaaataacatgaagaaaacttgaatgaaacacaatgtacgcttgctacagttacacagaggcctagataatgaaattaccaaatacagactttaaaatagatatgcttaatatagtcaaaaagaagaaagacaaaattgggaattttcacagaaactaggctatttaaaacacaaaaataatttctataaatgaaaaataaaatagctgaaattaagaactaaatggttaggcctaacagcagcttagactcagctgaagataacactaataaactagaagaaaattcagaagaaaatgtctagaatgaagttataaagtcaaaagaaagaaaaaatagaacagggtaagagacaagggggcacagaaagaaagtctaatatacatggaactggaatatttgaagaagcaagagaagggtcagaagcattatttgaataaatatttgctaagaattttccattacagatgagataaatgaaaccagcactattcaaggacccctacaaatgccaagtaaaataaatgaaattttaaattaaacatcataataaaactgctgaaaagaggagaaaacagattactatgtggggtaataaaacagattactatcaaaggagcaataagaccgggtgctggggttcatgcctgtaatcccagcactgtggaaggccaaggcgggtggatagcttgagttcaggagttcaataccagactgggcaacatgtgaaactctgtctctaccaaaaacaaacaaacaaacaaacaaaatattagcagggcgtgctggcacatgcctgtggtcccagctactggggaggctgaggcacaagaatcacttgagcctgggaggcagaggttgcagagagctgagactgcaccactgaactccagcttgggtgacacagtgagaccctgtctcacaaaaaaaaaggaaaaagaaaaaaaaagaggcaataaaagaacagcaattgactactcaacagaaactatgaaagtcaaaaaacaaaggttatgaggctagattaaaaaaaaaaattccatgctatgccgtttacaagagacatatctgaatgacaaaaatatcaaaagtttaaatttaaaagcctggaaaaagagaactttactagagattgacaaactgcttgtcaaagtggttgtataaattttactcccttgtataggagttcttgttactctacattctgttcaacatttgcactgtcagtttttttttaacttccagtttgatgaatgtatagtaatatcttattgtggtttagatttgcatttctctgattactaatgtagttgaacacatgctcatgtttttttgaccatttggatttcctcttttgcctgtttaaattttctgccatttgatatatttgcctttgttcatcaaagtgtagtttattaaacattctaaatactggtcttttgtaccttgatggcttgtatttacattttttaaaatgtatttttttcactgtcctatcttctatgagagaatcacatactggtcactgactcaaagtccaaacaacagctatgagagagcaccaaacatcccgggcttgtctccaagtttgtgttgtaattgaaacttaattagaccataccatattctgtcagctctgcatgatggggtgtgtgatatatacatatgcacataaatatatgaccagttaattccacgaacttggtggttctggcagaaacaatatggggatggaagactaatcacacacacacacacacacacacacacacacacacacacacacacacacaggaatagatatattctaatctagtagaacaaataatttatccttccagaatgaaaaccatccaacataattcacctcaacctgtttccagatggcagcttggttctactagggaatggtggacttttggaattggtctctgatgctggcaaactgggtattctgcagtgacagcaggtagatcatccttggtaagaggaatccaccttatcaaatccacaaatggtctccattcctgtctccatggttaccttatatatacgtttatggtgcttatatatgattatatattatatatattagatactagtctgtctgtatgtataacttatataagtatatggtatctaaatactttttatataagtacatgccagggaggctgccattcccaaaataaataatcttgtccacctgatgattgagagccacctttatatatcttttacaggataaacaaatgggacacagatatctgcgtattttgtccatttcaagaggtacacccacatacttgtaactctctgttgccaatcttttaatatttctttctggagatttttttttgagacaggttcctgctctgtcacccaggctagagtgcagtggcatgatcttggttgactgcaacctctgcctcctgggttgtagcgattctcctgcctcagcctcccaagtagctgggactacaggcacataccaccatgctcagctaatttttgtatttttagtagagaaggagtttttccatgttggccaggctggtctcaaacaatctttaatatttcttgtcaactatctgaacatatggtctaatcattagccactgccatgttagtatggatctgtacctcaggttattttttatccatatgaggcagaaaaccagatgtacatcttgacgttctgcccattgggaggatttacttttacggtttttcaggaacactcttgatggtatagtacaacattggccaacttctagctgaggacagcatatcataaaggacaatctgtaaatgagcccattatttttctttctctgtcaacttatcataaagaattttctatgaggccaaaagtgtaaattaaaggtgagacagccgtgcagcaagaactggtgtcaagagaacccgagccaccttctcatgcaacttactcacgccttcatgactgattcgaacctgacctctgtatgtaccatttccatttggtgatggattgattgttcatattccaaattttgggtcttgatgaatcagttaatacccacttcatgttagacagctctgttgcaaaccaggtgctatttctcaaaagaattatctacagaagagggagtgcctttgctccaaaattccagggatcttcctattgataaatgccactcagtaaatgggtcagagtagcatagtcaaatgggatctctaacactgaaaaatccaaagtccaccaagtgctatgtcactttctaattggtatattccaaaggtgcaataactcatctttcactctgaagggaataacctcaaattgtctacagtattgtaatttagaaacttcacttctgtggtgggattttggcatgtatggtcttagtagatcagtgaaggaatttgccatttactgttcaccaggccaatttagcagaatgtcatcaatgtagtgaaccaaagtaacgttctgtgggataacaaaatgattcagatctgggaagactagattttgggaacactgacatagtctgaaggcaaaattgtgaagatgtactgctggtcctaccatgtaaaagcaaagtgcttcttttcgtccttgcaaattgatatagaaaaaactaattgaagtcaaaaaaactctgatttccactttgcccatactaattataatgactgttcccaccttctctttggaggttaagttttgtccctctgaaatcttattattctcagtgaaactaaagagcccatttcagggctggcatctctcatcatcctccctgggttctgaagagcacagccaccacggagtttttcaaagatgaaatgctcctctcattgaagcttttttttttttttgagacagagtctcgctctatagcccaggctggagtgcagtggcgtgatctcagctcactgcaacctccgcctcccgggtcccagtttaagcaattctcttgcctcagtctcccgagtagctgggattacaggcatgcgccaccatgccaagctaatttttgtatttttagtagagacaaggtttcaccatgttggccaggctggtcttgaattcctgacctcatgatctgcctgccttggtctcccaaagtgctgggattacaggagtgagccattgcacccgcccactaaggcattttttagtgcattagtaaatggagtgtcctctggggtatatgattgagagctaccttggagttggggtggctgtggggatgtgatagccatgataaaacattccaacattttaatatctttaagtctttgtactgcttcctcttcaacacaccaggaagttctgacttctcaatctcatttaacgagacaagtttaggtctcagtttcagtcaagcaagcaagcaaattgttagagtcagtcttagccatcatgctacatcattaaacccaccatctttattgataaattcagtctgatccagaattatattacatcttcctggctctaataactttagacttatttcttacacatattccccaggatatataagctatctcttcctgaatatttaaaaatcaaggatcatatgaagaaagttggtgatggttaactttacaactggactctggtttatcatgctttttttttttttgagacagggtctggctctgtggccaaagatggagtgcagtggcatgatcttggctcactgcaacctctgcctcctgggctcaagtgatctcctgcctcagactcctgagtagctgggactacaggtgtgtgccaccacactcggctaatttttgtctattttgtagagacagagttttgccatactgcccaagctggtcttgaactcctgcactaaaatgatcctcccaccatgacctcccaaagtgctgggattacaggcataaggcaccatgcctggcctagagtagagttcttaatgtttttggaaatactattcaaaggaactcagggcaaaaaacaaaagcaaagtaaaaaaataaatgacaaactgagagactaaataccacagataagggaaatctccctaatatacaagaactaaagatcaagggaggaaaaaagaccaaaaaccctgagagaaaaatagacaaaagacatgtaaagattgttcacaaaaatatagacacaaggaaaagaaactgtcaacagagtaaacagacaacctacagaatgggagaaaatactggcaaactatgcatctgaaaaggtctactatccagcatcaagaaggaacttgaagttataagaaaaaagaacgccagtaaaaagtgggcagaggacatgagcagacacttttctaaagaagacatacatgtggccaacaatcatatgaaaaaaaactcaacatcactaatcattagagaaatgcaaatcaaaaccacagtgaaatacatctcatactagttagaatggctactactaaaaagtaaaaaaataacagaccctggagaagttgtagagaaaaagaaatacttaaacactgttggtgggaatataaattagttcgaccattgtggaagacagcatggtgattcctcaaagacttaaaaacagaaataccatttgacccagcaaatatacccagtatatacccaaaggaatataaattgttctaccataaagacacatgcacgcatatgttgactgcagcactattcacaatagcaaagacatggaatcaacctaactgcccatcagtggtagattggataaagaaaatgtggtgcatatacaacatggaatactatgcagccataaaaaagaatgggatcatatcctttgcaggaacatggatggagctgggggctactatccttagcaaactcacacaggaacagaaaaccaaataccatatgttctcacttataagtgggagctaaatgatgagaacacacagacacatagaggggaaaaacatacattgggacttatcagagggtggtgggaggagggagaggaacaggataaataactaatgggtactattaatacctgagtgatgacacaatctgtacagcaatcccccatgacacaaatgtacctatataacaaagctgcacatgtacccctgaacttaaaagttaaattttatacagaagatagaaagacagacagacagacacacaggcacacactcagcaaggtgtggtggttcacagctgtaatcctagcactctgggaggcggaggtaggaggatcttgaggccaggagttcaagaccagcctggtcaacagagggagaccctcccatctctatttaaaaaataaaaaagattaaaaagaaaaagacactcaacttcactaattagaaagtgcaaattaaaattacattgaggggccagacacagtggctgacacttgtaatcccagaactttgagagtccaaagtgggaggattgcttgaggcaaggagtttgagaccagcctgggcaacacagtagactgtttctaccaaaaaaaaaaaaaaaattgttgggcatggtcgcatgcacctgtagtcccagctactcaggaagctgaggtaagaggataatttgagcccaggagtttgaggctgcagtgagctatgatcacaccaccgcactccatcctgggtgacagagcgagaccccgtctccaaaaacaaacaaacaaaaaaccccactagtgggccaggcatggtggctcatgcctgtaatccaagcgctttgggaggctgaggcaggtggatcacttgaggtcattagtttgagaccagctcagccaacatggtaaaaccctgtctctactaaaaatacaaaaaaaaaaaagtagccaggtgtggtggcacatgcttgaaatcccagctacttgggaggctgaggtaccagaattgcttgagcccgggaggtggaggttgcagtgagctgagatcatggcactgcctgggtgacacagcaagagtctgtctcaaaaacaaaaccaaaaaactacattgagataccatttcttacctattagcttagcaaaaaattcagaagctggacaatccaatctgttggcaaggctgagaggaaacaggcatggtcatacaacccctcgagaggtgaatttgacaataccctataaaatgacatatgcgtttaccctttgactcaacaactctacttgtagaaaattatcctgcaagatgcatttccagcaatgtgaaaagacagaaggccaagattattcctcatggcattatttaagataacaaaatacatattatacctttgtattgacagatagatgccaatataaatcaataatgggaaaaccctaaaattgaattcaaatagaaacaaacttagatattaaattaaatatgtaatcatacagaaaataacaattcaagtaacttttaaacgtagtattctgattataaaagtttttgtctaaggaaaaaaaacactggaaaggaatctcaaatttcacttaggcttgtgtttgtcatggttgtaatgtaataatttcaaaactattttgtatgtataagggaagcacaaacatggaaggagaaagatgaggaaccaccccagatgttggattttaattggtggattcatgatcttaaaaaggcccaggttaggagcaaccaggttagggtttctaaatatcactcattaccaaaagaaatgagatcagtgagggggtctttgcagtggctgagaaatgaggtgctgaggcctgctcaggggctgggaaacaaggctgaaattcaaaaaagcactttgcgggatgaatagatagaattgcttccctcagtaaaggagaagagagaatcagtaagtgagtttctatgatgaagagtggaaggggccatgatggcattgaactaaatatgaaaggcagagaactggtttttaacatgttttgaatcaattttgaatatgttgactttgagccaatagctttcagatgcttacaaacctccagaagttaagggggtgtcccaatttgggggtagtgtttctggtccttctcctcaaccagtttgatctcttacttacttcagggacagagagggcgccaggggcttcctgaggcttctgccaacgattgcctgtcatagggattacacgatgctccacagacaacgcccagaatcttctccctgcaggatcccagtgggctactcttgagtgagcgaacatcaattcccaattggggcagaaaagcattttcaagacctaactcagggacgggcccccacgtgtggaatttctctttcatccctgcagcgaaggctgactcggggcctctgtggtttgtggctgtctggcttcatcaggctccggctgcccccctgcctgcccagcgctcctgcctggctacagcaagcatgtcctgagcatccattctgagcaggcttcccgggcagccttcctcccctgcactcttggcattcatgtggcatggctataaattatgtccagcatgttcattttcagtttaaatgtgttctcatcccaaaggagcaactaatggcatcaagttactgacgtgaaaaaagcctgccgctacaatgactatggattaatgaaatagcagtcatggaggctggggtggcaataaatcgccagccactggtgacacgaattttaaattttgttctccatcccttgcccccttctccaaaattattttgctgtaaagttgtttggtaaatgtttacctttgcttagatgtttgctttctattaaaagttgatgcaggcagggcccctagctcttagaaaactggaagcgggatgagagggatttaaaagcctatcatgctttctctaggaggcgtgaaggcaaatctcttaatccaggatcatcactgactgataaatttcattcagaaaatttggcaaacacaaggttctttcagtgaacgctgctcatctggcatgtaagttactattcctaccttctgttatgacttttttcctaatgaatttaaaatgaggaacccgtacaattcccaccagtgtttttgaaaggtagcaagtctatttctcatctgatgaagggccccagggtatccactgatgggccacagggagtctcagaatctctgatcctaaaagcaaactgttcatacgtacagttggccctctgtatctgcaggtcccgccatctgtggattcaactaatattgggttgaaaatattcagaaaaacactgcatttgtatggaacaggtacaaactttttccttgtcattattccttaaatgcagtatagcaactatttccatggcatttacattttagtaagtattacaagcaatctacagatgatttaaggtacgcgaggatgcgcatgggttataagcaaataccacgccattttatgtcgggaacttgagcacctgtggattttggtacccaggatgtcctggagccaatccctcatggataccaagggaaaactgtatggttttctagaaagaaggtctttagattcatcaaattcactaaatgttctgtaacatcaaaaacaaacaaacaaacaaacaaacaaacaaaaaaacaaaaacaaaaaacgtaaggctaactatggtggactgcagtgatggctccagtttcttcctccccaggtgtccacgcccttgcaatggtgctctgcagtccctcctaatgaggagcctgtacccatcccttgattctggggtggccttgagattggctgtggtccatgggatactaatatgatacaagcagagttgaaaaagtatttgtacactggggcttgcctccttacagtgcccagaactccacagccacgtgaacaaggctgggcgaactgatgagctacatggcccagtcacctccacttcccagcagacctaccaaccagcaaccacatagagtgagtgagcccactgagaccagcatgcctaggccaaaccagaaggactgtccagctcaaactgctgacttacaataaccttaaaaaaaaggttattttaagcaactaagttctggggtagtttgttatgcggtaaagctaactgacttgctaggttggggaagttctcctggataatatcctgaagagagatttccagcttggttccattctccctgtcactttcaggtacaccagtcaaacgtagatgtggtcttttcacatagtcccaaatttcttggaggctttgttcatttcttttcattcttttttctctaattttgtcttcttgctttatttcattaagtcgatcttcaatctctgatatcctttcttccacttgattgatttggctactgatacttgtatatgctccacaaagttctcgtgctgtgtttttcagctctatcaggtcatttatgttcttctctaaacttgttattctagttagcaattcattgaaccttttttcaaggttcttagcttccttgcattgggttagaacatgctcctttagcttggaggagtttgttattacccaccttctgaagcctacttctgtcaatttgtcaaactcattctccatccagttttgttcccttgctggcgaggagttgtgatcctttggaggagaagaggcattctgggttttggaattttcagccttttttttttgctggtttctccccatcttcatggatttatctacctttggtctctaatgttggtgaccttcagatggggtctctgagtggacgtcctttttgttgatgttgatgctattcctttctgtttgttagttttccttctaacagtcaggcccctctgctgcaagtctgctggagtttgctgaggtcctctccagacccggtttgcctgggtatcaccagcggaggctgcagaacagcaaagattgctgcctgttccttcttctggaaggtttgtcccagaagggcacccaccagatgccagccagagctctccggtatgaggtgtctgttggcccctactgggaggtgtctcctagtcaggatacacaggggtcagggacccacttgaggaggtagtctaacccttatcagagctcgaataggcaaaaactggaagcattccctttgaaaaccggcacaagacaaggatgccctctctcgccactcctattcaacatagtattggaagttctggccaggacaatcaggcaagagaaagaaataaagcgtattcaaataggaagagaggaagtcaaattgtctgtgcttgcagatgacatgattctatatttagaaaaccccaccatctcagcaccaaaatctccttaagctgataagcaacttcagcaaagtctcaggatacaaaatcaatgagcaaaaatcacaagcattcctatacacaaacagagagccgaatcatgagtgaactcccattcacaattgctacaaagacaacaaaatacctagaaatacaacttccaagggatgtgaaggacctcttcaaggagaactacaaaccactgctcaagaaaattagaagatacaaacaaatggaaaaacattccatgctcatgaataggaagaatcaatatcatgaaaatggccatactacccaaagtaatttatagattcagtactatccccatcaagctaccattgactttcttcaccgaattggaaaaaaactactttaaatttcatatggaatcaaaaaagagcctgcatagccaagacaatctaaggcaggaagaacaaagctggaggcatcatgctacctgacttgaaactatactacaaggctacagtaaccgaaacagcatggtactcgtaccaaaacagatacacagaccaatggaacagaacagaggcctcagaaataacaccacacatctataaccatctgatctttgacaaactggacaaaaacaagcaatggggaaaggattctctatttaataaatggtgttgggaaaactggctagccatatgcagaaaactgaaactggacccctcccttaaaccttatacaaaaattaactcaagttggattaaagacttaaacataagacctaaaaccataaaaaccctaaaagaaaatgtaggcaataccattcaggacataggcatgggaaaagacttcatggctaaaacaccaaaagcaatggcaacaaaagccaaaattgacaaataggatctaattaaactaaagagcttctgcacagcaaaagaaactatcatcagagtgaacaggcagcctacagaatgagagaaaaattttgcaacccatccatctgacatagggctaatatccagaatctataaagaacttaaatttacaagaaaaaaacaaccctatcaaaaagtgggtgaagtttatgaacagacacttcttaaaaaatgacatttacgcggccaacaaacatatgaaaaaatgttcattctcactggtcattagagaaatggaaatcaaaaccacaatgagataccatctcacactagttaaaatggcaatcattaaaaagtcaggaaacaacagatgttggagaggatgtggagaaataggaacacttttacactgttggtgggagtgtaaattagttcaaccattgtggaagccagtgtggtgattcctcaaggatctagaaccagaaataccatttgacccagtgatcccattactgggtatatacccaaaggattataaatcatgctaatataaagacacatgtacatgtatgtttaatgtggcactgttcacaatagcaaagacttggaaccaacccaaatgcccagaaataatagactggattaagaaaatgtggcacatacacaccatggaatactatgcagccataaaaaagaatgagttcatgtcctttgcagggacacggataaagctggaaaccatcattctcagcaaactaacacaggaacagaaaacccaacaccgcctgttctcattcataagtgggagttgaacaatgagaacacacggacacagggaggggaacatcacacagcggggtctgtcggggcagtgggggactaggggaaggatagcattaggagaaatacctaatgtagatgatgggttgatgggtgcaaaccaccatggcacgtgtatacctatgtaacaaacctgcacattctgcacatgtaccccagaacttaaagtataataataataataaacctcaaatgagagggaaaaaaaagctaactgatacaagtaccagaccagacagtgtccgtttggaagatggggatgtgtcttattcagtctttgtatctcctttccctttaaaccctgtaaccattcaatatgtatttgttgaactgggtagaaatggccccttgaaaaggctgcaattaaacccctttttctcaaggctactcaagtcaatcaggagggaaacagcacaccaaggattccatttcctcatttttataaaatgggcttcaaaatacctaccttgtcatgctgttgtggttgttaaagatcctgtgtgctttagagatgtccttgatacataatagacggtggctcaagcagaaacaagcttatggaaaggctttagaactcatcaggatgcaggatattgtatattttttttctatcaaagtggtcaccatgtgttcagcctaagaggactccagtttcaagtcatcagctttctctgttgtagaagtaaggttggttccttcacgctccatcagacatccatgtgccattctaacagtgcctcgtcagaggacttgcggcgccctctgtgaaagacggggagggctcctgagcgggactcaggaatgtgggttgctactctggattctgccaccgcccatttccttgcttgtgaaataaagtgtggatgactgcacgctctctaagaatcctttcaactctaggaatccacgggcttcagttaccaccagtgtcatctaagcgtgagggactgcactgctcacaggatccctgagccataagacaattgacatttttagaagtggaaaagaaaaggttttctgtatttgtctaaagtagaaaggcagaagaacaggccaaagaattaggaaataataaagaggaaaaagcaagcaagcaagtctgatttgagctgggatgcgagaaccttgcttgctgcaggataatggagctttacaccgtgcataccacactcacacactcacatgctgaaccacacatttggctaattacagaaaaaatttcaaggaaaaaaaaaagacatacacaaggagttataaaatgctgatgagaaaggtttacacaaagagctgtgagacattcgaaaaactggtttttggcattaagacttcctatccttttctagtaatatctaaaatggcttcttcctagcatttaggataaaacttcttgtgttggagaagtatttggaagtaaataacaaacacaaacatcatttatcacaaagagcaaaagatgacatctcaaaattctgcttcttgccaaaatggacattaagtttttgcttggaagcaaatgtgaaaatagtgacttttatctaattatccctacatatatccaaagagaaagttataacttatttgtcatgcttttaatatgattttctgtcttgaatgttggtattttaaacattaaaatcgccaatgagtaagcaaataagacaattaccagatggcatcctcaaccaaatgttttgaatttattataatcgtgcttctctacaactaatgattcttgtggtttgcaaaccatgtctgcctttatttacctacacaaacacggaacagaatttccaataggagaggttcacacagctaacaaagcatagagtgtgtgacctcaataaggcattcaacaaagacacacgccgtatttccctctgactgcgttcccttaggatgctctgatgttggcgtcgcattcttctaaaagtagaatcaaatcttcaatcaggctgtgttctctgccatgtgtcactctcataatatcaaaagcctaaagagaaaggacggaagagagattagaccccaaaataggtgagctcaggccattccccacctttaccccatgatgccaggggcctggtgaaccccacaggtttacagggtgaacagtctttaacaggcttacagcactgtggttctcccagctggaaagtcacatgaaaagggtgatttctgaatgtggtatttggaaagcagactcactattcgagtcatgctggggcccagtgacaatcgatgatcttcaaagactgtcagtgcacaggtttggtgggtagtcacagggataagaagagttaccaaaatgattgagtcatatgaaagaccatgctgctaccaccttaaaatttttctttattgcacactccattcaattctcatctatatgcaccaggattattatatacatgtattctcacattttttttcatatcatattatagcactggcatttcaacagtcctctccttcactgctcatatttggtccattattaaatcttgtcaactcttatcttcaaaatatttctgaaatctgtgtgggcttatgagtacttcaataatagagtataatagaagtaaagcaactgacttgtgagactaggtcaaaaaggcctctgtgttgtttactggtcagtatgtttgctcccagaaccaagagactccatgctgcaaggaagcccaagccacatagagggaggccgtgtacaggcactctggctggcagtcttagccaagctcatctttcaagtcattctagacaaggcaccagacatgtacataaataaaccttcagacgattccagcacccagctgaagactgccagatctgtcttcccagatgaaacaccagacattgtagaaaagaagaaagccattcttatgctgtgtgccaattcctgacacacagcatttgtgcaataattttgccgttgtttactccattcagttttgggatggttatggaacaacaaacaaccagagtatccttgaaaatatttttgtaataaataagagataagcaatattatcctgccctgcccaaatgggggggtggggtggggtggggtggactggggagaagggagggacaccagaaccactgcatttgatgtaaatgtgcccaggagacttgtaaagatatgactctggtggctgttatgcacccaaagtacctggaagtggcactgaggctctcagccttagctacacagcaggatcaaccagggagcttcaaaagagacaccgagggccagaccctgcacatcaacagctgaagcctgctctccaggaatgaggcctaggccccaggagattccaacatgttctcaaggttgaaaacaactgatagagcaaactctcaacaaataacatcaactactcatgattcagtgttaatttatagccagaagaattaccattttaattgttgtatataatgaatgccatcatgcttataaaccattatttactaagctactcctggaaatttagatcacctccaattgtttattaggatatgatgcagaccttccagaatagattttttgcctttcttggatatttaagagcaattgctaggggtggaattcttgagcatgaacatcttgaaaaccacagagatttcagaccttggtggtcatgtggtgagacgcctgcattttgcaattctgcatgcaggaaaactttccattctacgttggaaaaacgctgaagcttcgagaaacaaagcatttcagggggatgggtaatttcaacctctgtttctggcttcttttttcacctcttgaatgttccctttaggctggaaggaaaacaggcagacagagggggtctagatttgctgctgagagagagagaaagagagagaaagagagagagagacagagagacagagagaaagagaaagagagagagagagaaagagagagagagaaagagagagagaaaaagagagagagagagaaagggccagcgcctcagaccctggcctctcagcctggaagacagctctgctctgagtccagttgtgaccccgcactggcagtctggcccctcaccctgtgacactccagctgcaaagcccagaaggtggctggagctgagatgctggcggtgggaattgacttcctattcatgcgagcaagtctgctctgtgggtgcacagcatctgccagcaaatccctaggcagggggctgtccggagtgcaggggaggagttgggaccagcccccaccttgcaagcagcccagctctatgagattcccctgggcagaagattaaaaacaaatgtttgatggcattcatggagcacatgcctcgtgttttattctcttttctccacactgccctggatcctccgctgctctggacatcttgaggtctgaggcagagacctgtgtgacagcacgattgcggaaagagaaggtttctcagatcagagagccttcatgggaaattttcttacttgaaagcactcttagatgttctcttcccttttactcaacaaagagccagagtgcttgtgatctggcaaaggaagatgaatggggcagaatcactgcctggaaagatctttgcagagagggacgtaaccctccgtcctgaaaaaggccagacctaacctgctcggcctcgcctccctccctgccctcacagaggccctcggctgggtgagggcctggccttgttgctcagaatttccagaccagcctcttttttgccctcctggttacattccccaggttccccatctgaagaatgatctgtgcttctctctgacttgactcagaggctaaatgacaaagccatcttcttgtcacttcaacaacataagttcactggcatgctttgaacatactacaggctccaggcttccttcctcgctcttttcttccagttccagtggtgagtttcactttctcctcttttgcagctttaagagtaaggtctactccccactgatccagtatattcctgttcatggaaggggcagacctgcccatcccacagtacggtaactacttccagttcttcagccattctggaattagagccacagccaggaagggggagtttcctggccttcctccagcttcacatccacacctcacagcctgcttccttgaggaaagaccagaaggatcatctagtccaataccctcatgttatggaaggaagtgcttcctgaggtcacctggcttgagagttagactaaggatgacctctcggctctcaggactcaacccagtgtgtccattccatgactgcattgtgcagcctccccgtatgaacagactgcagtgaccaaggagaggagcagaggctctcctggacatggctgcagagataccctgaggggacacaggtgccttccttgtcaagatgctgctggtcatgttctgtgttctcttacttgatgctgaatgcatcaccagtagcaaaggggaacaggggcaaccctcaggaatgtgtgtgtagagtctgagatactaagtttagaggatctcgtccatagggtggctagaaacagagaggaaatgggtatgggtaggggcagagaactaatctgaagcaactgaaaaaaaaaaaaaagaaactacatcatctgtctagaaagtaaaacgccatatagatttgattaattcacaagcaaacatacttttctctgaaagatgggcagatgtagatgagaaagggagagaaaaacgagaagaaagaagtaggattcagtaatgtgcaaaatatgttagtgactgtgtgtgcggatgtgtgcgtggatgaatggtgtgacacaggtcagcaggaagctgcaattcacacctggtgatgaggacatctggtccttgtcttgaacatcacctgggcctatgggtgagctggggcagacagtcctcaacaatgtacggagagggccctgtgtggccctgggcacagcccttcagcactgggtgagctggggcagacagtcctcaacgatgtacggagagggccctgtgtggccctgggcacagcccttcagtacagcaggaagatgaggagggcttcccctcacattaccatcccccaaaaaagttacaataaatttctgacaaacgagagcaattgtttcaagtagctctgtgtctcccttctcctaccactcccatctgtcacccatgcgcatgtcagagaggacaattctggtttaatttcctgcagtagcatataaaacagattaaggaaatataaaattggagcaggctggtgttgggaaaagcttatctctttccattaaattttattttttttaatggtagcatttaaaaagagcctgcacataatctttcacagagcactcatttgaagcctccaaggagggtgcctgctacacccacatccagactcgaaatgtcacatgagaaaagcagcatagcttgtctgccacattacaggcatacagttaactcagtaatagagaaagggtccccagaattgatttcaatctcatctgtttttttaagtaattttagaattgtggtcatatattaaataaaatgaatttaaatcaaatcataaagttggaaacaatatacctctcctattaattttaatatgaatatattaagcttatcaaggatctcaaacagtttctaccatgagcttgaggaatctagtaagtgacttcccaagtatgatttaaatatggatataaaatcagagggaaaagaaatgtatgcatgataagaacccctggaatcaaatcacgacgggaaaaaataaagcaggttttcttattctgcccaactcagaatgaaagaaaagcagagggtggggcacagggaggaggaagctggtctggggcattcaaaggaggaaatgcaagaagcaagaggtacaacacattaagcagctctggaggcacaaaaagccctttgcaaggacagcagagaatcccaaagactttgatgatccacctcagctcagcagcacccctggagaccccactccactctacatcttggataacttcaagtgtgtattccgctggaggaatatgtccttttgggaggcagaatttccttagagataacatctacccattcattcactcaatactgtctgagcagctttaatgaataaaacttggcccttgccctgggagaagctctggcatagtcagagggacagaatgtaaataccagatcattgcagtggaacagtgtgtgttcaacagagatgcaaagtgctggggcgcccagaggaaggaggaaccaggtggccccacggcaccctcaggaggggttacagatgtggtgagctcaggtctgtgctttccagtggtagtagccattccagaaaaagcatggctgttgtatcactgtttaatcaatcaatcagtacatattaattgaactctgagagactctgaagaagttatgtttcctcagctaaataatgagactggacaatataaattctaagggcaacccaagtcccaatgtgttgtacaatgtgccatgccagacacagctacaaggcgtggatttggttttgtttccaaatattgttactgatttctaatttaattccattgtggtcagataatttactttgtattaacttgaatctttttatgtttattgatatctgttttgtggcataaaatggtctcttttggtattatagttacttaaaaatgtgcattctgttattgctgggtgaagtgttttctaaatgtcaggtcccattggttgatggtgttatggaattattttgtatccctcctcagtttctgtctagttgttctaccaactgttgacagaggaggtctgatgttcccagctgtgcttgtctatttgctcatttctcctttcagttctatcagtttttgtttctcatgttttgcaactgtgttgtttggtgcatacatatttagtactactatgtctttttggtagactgacctttttttcattatacaatgtccctctctgtctctcataacattttctttgctctgaagtctactttacttaatattgatatagctactccagctttcttttgattgtgtttttataatgtatctttttccatcattttgctttcaacctatttgtatcattctatttaaaaagaattcttacagacaacatatgcttgagtcatttgttaaaaatctgttctactaatctctgtcttttaattggtatatttaggcaatttacatcttttacatagactactgacataatttacaatgttattattaatacatcagggcttaaatctgccatttaattttttgttttctgtttgctctctttttctttctttttcctgcctttctgtgggttaaacttttttttagaatttcattctctagtgcttttgagtgtattactttatatagttttgtggttgctccacgtcttattatttatatatattttatatatatatacacacacatatatatgtatatataacttgtatataatatacatgtgtatgcatattatatatgtatatatacagatatatatgtatataacttatcatactttactagtgtcatcattttacccattgaactcaagtgtagaaaccttccctttacattttaccctcccccactcccccatttgtaatacaattgccctaaatatttctactacatacatttagaatcatatcagatagtgttataatttttgcttcaactatcaaacaatctagaaaactcaaggggagaaggaaagatcattttacttacccacacttttgctgaccatattctttcttctttcctgatgttccaagagctttcttttatcattttctttctgtttagagaacttctttagccattcttttacagtaagtctgctagcgataagttcttttagttttccttcatctgaaaatgtcttgatttcttcttcattcctgaaggatattcttgctggacaacatacattctaagggcaacccaagctttgggttaacagttcttttctttcagtacttgaaaaaaatatgctactttcatctggcttctgtggtttctgatgagaaaatcactgtcattcaaattgtttttcctgtacaggtaagttgtcatttttctcttgctgcttttaggactttttttttttttgtctttagttttcagaagtttgagtatgatccacagtcttggtgtgaactgctttcggtttatactgttcggggtttgcttagcttcttaaatctacaggtttatgtcgcctgccaaatttgcaaagttttccactattaattctttttttaaaaacaatatggtaaagtacacaaaacactaatagttaccattttaactatttttaactcttgagtagcattaagtacattcacattgttgtgcaaccattactactatccatatagccataacttttgcatcatcttgtactgaaactgtgtacccattaaacaatagcttcccatcccctcctcccttcacactctggtaaccactgttctacttctgtctctaggtatttcactattctaggtacctcatataagtggaataatatgatatttgttcttctctgtcaggcttatttcactttgcataatgccttcaaggttcatttatgtgtagcatgtgtcacaattttattcctttttaaggctgaataatattcccttgtatgtatatatcccattctatgggttgctttttattttgttgatggtatcctttgatgcccaaaagtgtttaattttggtgaagtccaatttgtttatattttcttttgttgcctgtagctttggtgccatatccaagaaatcatcactatgcccaatgtcatgaggctttttccttaatgtgttcttctaagagtctagtagaagcttttgctcatatgtttaggtctttgatccattttgagttactttatatggtgttaagaaagggtctaactttattcttttgcatgtggatatgcagcttccccaacactatttgttgaagagactgtcatttttccattgagtggtcttggcatccatgttgaaaatcatttgatcatatatgcgagggtttatttctgggctctctattctattccattggtctatatgtccatctattccagtatcaccctgttttgactactgtagctttctcgtaaattttaaaatcaagaactgtgagttctccatatttcttcttctttttcaagactgcttttggctatttgggattccttgaggttccatatatatttcaagatgtatttttctacttcttccccaaaaaagccattgggattttgatagagattgcattgaatctgaagattattttgggtaatattgacatcttaataatactaagtcttcgaacctatgaacatgagatgtcattctccttatttatgccttcttcatggagaataacttattcagttattctcagataataacttacttggttttgtgttattgcaaatagcattattctcttaattttgtttttgaattgttcatttttagcgtttagaaatacaactgatttttgtgtgttgatctgtatcctgctaccttgcttaattcacttattagttctaacattttttggtgtgtgtgtgtaatcttcagagctttctccatatgagatcatgtcatctgtatatagagataattttatttcttcctttccaatttggatgcctccaccattatttcttcaagcactttttccacctcaccctctttttcttttctttctgggactccaatgttagatcttttgttactgattcataggtcccctgaggcactgttcaattttactttttcttcagtatttttttctgtttttcagcttgggcagtttcaattgtcttatcttcacattcaccaattcattcctctgtttcctccattctgttgtggagctcccttctgtttattttgattattatatttatcagttgttaaatttctatttgtgtcttctttacggcttctacttcttaactgagattttctattttttccatttattttgagggtgtttgtaattccttgatgaagcatttttatcatggctgctttaaaatctgtcagactattctaacatctctgttatcttggaattggcatctactgattgcttttattttcattaagattgagatattcctggttcttggcatagtgagtgatttttaactgaagcacaaacattttgagtattctgttatgagactctgaattttacctcaacctgctttagccggctttctctgacatcactccagcaagagaatgaagtgatgacaccctgttactgccaggcgggagtacaagttcaggttccctatctggctccttgttactactgaactcatacttcctggaaggtaaatttctgcttatttcccataatacgacttaatcactgtgtttgcattttatccattattttcttatcttttctcttttttggttcaaaaacacactcttggaactattattctctatttggaggtcagtaggaatcactcataaatattagagccaggggcttccaaacaactctttgaaggtattagtgacaattacgggacatccttccgcatgccctcttactccccctctttccctcccacctccccacacggtaacgtatgatgttaagtgtttagaggagggctttttaacctaggcaccatggatactaagtccatggaagggcttcagggagcctctgaagctgccatccccaccaaatatacaaaaggttgtgtatatttaacttttctctggttagtcagtggccctcatcagattcctaaatagggacacaaccaaagaggttaagaatcactgtagcggattaagacatgggaacaacagaactgcatgctctaaatcagccattgctggggctgaaaatcagggcagccgatgcaggaatacaaggagcaatctctaggacttgcggcctggtgctgtctgttgagatgcagaaaaagctaaaaagatgctcaatgggtaaaatactgcaataaaatcaaatgagaagggaaaaattgtaatacaaaaagtttaaatacagatttttttaaaaaaatggatgccgaggggaaagaagtctaacttttgcaaccagatttttgctgaaaagcaactacactagggccagggtgagggagcctgcagcatgcagggttcacaggaaaaaaaacaactctgattaacaagacagcccagatgggttgtccttgaggtccaagaagtcaaattagtagcaaacaaaagccttctaagaaataaatggaaagaaataaaagtagattagtgacaggagagggcaggagggaagcactgggaagggaccccaggactgtcctgtggcagcaatcacaagaatttcagctgagcccagtggaaatggaagactaaaccaaatcagagctgggctaagtggattcctttcctggaggaggctggagcctaactgaatctgtaataaatttctgtttctgaagctcctctgatttctattcaaactcagtcttcaaaaaccttattcaagtgatttcattccattatttccagggtttctaagacaagaaagagcatcccgagggtgcccgtctgaagatgacatcagtttcaaaaggcaaagagtatagcctcccttttccctctccaggttacccgagtcctgagaaagctcaggaaagaaagactttcttcaggaagaaactgacctgcttctagactcacaggtcacgtgagctttcctagggatggatacattcaggccatccctctgctagcaaatgctcagcaaaggtcatgagaagatctggtccattaactgtaaacagctaaccagcaggcccagggggaggcttttaaagacttctatccattaaaaaaatccattcattcaagcatgtatttaacagaacttgccgtattgggggcatgtgtgtctatgttaggtggcaccagaagacacaaaaggaatgtaaggtcccttgagggattcccactcaccttggggagcaaaacactgctggggagcagtcatagaacataattgttcaccagaggaaccaccgtgtaccccaaactacaaacacaagtactgaacagaccagctagtgggagagtgatcagaacaagagttcctgtaacaatacccatctttaatagtttcagaatgcttgagattggcaagcacactctcccgcattgcctcgcttactcctcaaaacaagtctatgggatagctatcagcttccttttacaaatgaaattatattcagagattaacgcaaatggtgggactggaacctgaacctactgactctaaatccttgcactctttctacaactctgccaggagtgcatgtttgctccttggttgatcatcagaccttggcaagagactcaatgacttttgtagagacacacagcaagtttgggtaaggccaccatttaaccccaggcctcatgacagataatctgatgctgctcccagaatacctttcatttggcatctatcagggtgtatgcctgagcttcaccttggtaccaagaataggaaaagctaacatgattacgaagagaagcttctgaaagaggcgatgcaacctcatcagaagggtgtgagggcagcagaacagacctgggcatgagggatgtaaagggcagtaagagggtcatctgaagggctggtgatggtcagtaccatcagcccaggccacattatcctgaaaatccatagcgagatgtctgtctgggtttgttcaggcttgtccttatagttgagggtattagatgtctccttcagaagttctgtatgcaatagcaatgactaaagcttcacataagaagcaatctaaatcttctctgatttctctcccatatttttccctgagttggcatcatgggttcggttagatcttaagggatttctgcacactgatcttactagagagcctcatctatttaactggaccagtctagaggaaaagagcagagccttggtttctggcctggatttaatgacttgtacatgtctatctcctccattaaattgtacacaccatattgagtctttttttttttttttttttgagacagtctcactctgtcgcccaggctggagtgcaatggtgcaatcttggctcactgtaacctctgccgcctgggttaaagcgattctctcacctcagcctcctgagcagctaggatttcaggcacccgttatcatgctcagctaatttttgtatttttgtagagacgggatttcaccatgttggccagactggtcttgaacccctgacctcaggtgatcctcctgcctcagcctcccaaagtgctgggattatagatgtgagccaccgcgcccagcctgagtcttattcaaagtagtagaagtatttgatcaccatgttgaattaaattgaacaaatacacctggctctgcctctgtgcgactttaggtgagctcttgcatgtctccaaacctgagcgccttcactttccaaataggaatgaaaatgcctgtcccattgacctcacacagctgtcacctgtcatggggactgagtatgatcacggatcacgtacgtacgagcagtattcatagtttctagtcccatataaacacaaaggtctagtctgatcacttacgaacatctacttgcaggtgaccctgtgttgggtgcatcgcacattaggaaatttcctgcacgttgtttttctgtcaggactttcacacagtaggcccttgataaggatttgctgtaccttgctgattcgactggctgacaagtacccccagaccagaaaaggaaagttctccctgaggctgcaacagacggtgcggtgttcttcccccgcctgggtaaacatgccagacatgataaaaagaacagaatagctgagtgccctcagggaatcctagtgttactcccgttggccacacgctgactttatttagagatcaagtaaaggcgctatggctagcattcggcgaaaatgagcactgtggaatctggcttttaagaatcccttcggcatttgtcatttctcttaggtccatgtgggcggctgccagtgttttgggatcagccggcccctggacacgccctgagcaaccctgacgcccgatccttccaccgtcactcttctgcacacaagggcatggcggcccagagggtcctgttaaagtgtcaagcgcttcctatgatacccgcacgccaggtctccatacaacccaccagtgcctggccaggtgagcatgtgagctctcctttggaagggtcacggactagaggagaggaagttctgctgaggtgggaaggcctgggccagacagcagagagccctgggctcctccgggcagaggagactccctgagcgggtgaaactaaccatcgtgttttaacaagctattccaaccctaaaccagttctcccaattagtttcttgacacttattgccagaaccgtattcactgacctccttcgcttcctccctcctccttccctcaataatgaatacttcctaagttccagatcccttgcatggcactgagctggttgccaagataaccacgaagccctcacactctcctgggggcaggggtaagggtggtcatcgggtatgcctactgcaatgtgaaaagggctctcctggcagggtgggcagagagctgtaggggtaggaccacaaagtaacactggaattgggccttaaaggatcagcagagtcctgccaagcccagggggttgtgatgcggagagcacttaaggcagaggaaaaaatagctgtgtgaagatggaggagtgagaagttcagggtcacagtgggtcctggtgaacagcagtgatcactgggtgggtggaaaggaagagaggaagggcggggagaagtggctgcaaaggtgaactgccacacagatggtcaagggcttgccacgcgagggacacggactgtgttccgtgggcaatggggaggaggcacaaacaaggtcaacttgctaaacgtggagagggcacaggagcagtggtgttctcagactggtttgtaccagtggcaagagtaattgttaatattatttttataagaaggttgattttacatttaaaatcagccatggtgggcatgcctgcatcacagaaataggcaaatgtcatgaagcaggttttttccagagtggttgttaaacatttaccagcacacactgggcatgcgtgtgtatgcgtgcacacatacatagagctgctaacaaatcacaaagaggcccagcaacagcagaaaaaaaggatgccaggcagaactatgtgagatcttggcacactcaccagtctcagattcttcattgcttggggaaacatgccttgatgtagctgcagtttgccaactttcatcacttgaacccctctgacgggatggcttcctgggaaaaaaatcctggaagaaaccaaacggcaaacagtgtcagcagccctcacctttgcagtcagcatttcatcaggagactacgaaagtggaagcagacactagctgtgaatgttaatgagctactgaaaggaaatcagctttgcaatccaggagaatgcagtactgaggggaattgacacaggactggtctccagctcctcagaatgtgttttgtgttagggaaaaaaaatgacaggactagaaggtctccctcataaacactagagaagagaaacaaaagtttggagctctgcgttgatatttgggaggggtggggcggggagaacaggtgctaatctcctcctccaagctcttccatgaagcatcagcatcagcactagcacagccctggaacagcagattgcctctcaatatatatttgttgaataaacaaagttttcatcatcccccaactagatcctaccacaccccccttttaaccgcaaagccctttgattgaatctcagctgtggagtccatcatggtacacctttcttatgagcacgtgtgtatttatttatcatctcactggattatagtgctttttattcaggcaccccatctgcgttctccatgatgtctgacatgcaggaggaactcaatccatactggaccctttcacatagaacagaatagaatacggtgttgtcgtggaccaaagaaagaggacgcacacgactccggctatgggctgtttcagaccctgtgaagagctgtattacttcaattcaacaagaatttaccatattggatttaaccaaatatgagcagtttggcctcttctggccccaataccccctacccctactcttagagaatactgagcccccgctgtatatgcagaattgtctctggtggaaatgcctacacacacacacacacacacacacacacacacaaaaccacagtttaaatgagcttttcaggacaggtgcgatggctcacacctgtaatcccagcactttggaggccgaggcaggcggattgcttgagcttaggagtttgagaccaccctgggtaacaaggcaaaaccctttctctattaaaaaaaaaaaaaaaatacaaaaatgagccaggtgtagtggagcatgcctgtagtcccagctacctaggacgctgaggtgggaggatcacttgagccctggaggctgaggctgcagtttcacaccactgcactccaccctgggtgacagagtgagaccctgtttcaaaaaaaaaaaaagttttttccttgaggctgaatcatcccattagacacaagataaacattcctgcaggagttaaaacaatgttacaggacggagcatgatttagcgcccaaataaggcataacttagtataccctagatgtccagttcaagtttgttgaattgaactgagaaaatgatacaagtattgtgaagacaaagaggtgactgatggttggttggactggggaaggcttcctggaggtgggaaattggacttacactggctcccaaggatttggagaggcttggctgggtaggagaagggaagcatatcccaaccgtcagagagaacgagcaagggcacactctaaatgctgcttctccagggacggaggtgcctgcccacagacatcactaagatgacctagaatccatcactcacgcagggcctgccatgtgccaggcgctgttccaactgcttttcatccatgaacccagagaaccccatctaagctctattatataacagtgatgaggcggatttaccaggagagacaggtatgttctctgaaaatgcacacatatctgcaaaccattccctctcgctgaatcttaactcttcctcccatgaaatgtgatatagaaacactttttttttcattcatgctcttaagaagtagaaagcagtacctgggaggaaagtatttaaaccgacagaaagttgggcatgcctcttttaaaaagctgaaaaggggctgggcgcggcggctcacacctgtaatcccagcactttgggagggcgaggtgggcagatcacaaggtcaggagtttgagaccagcttggtgaatatggtgaaaccccgcctctactaaaaatacaaaatttagctggacgtggtggcaggcgcctgtagtcccagctactcgggaggctgaggcagaaatgcttgaatccaggaggcagaggctgcagtgagccgagattgcagcactgcactccagcctgggcaacaagagcgagactctgtcttaaaaaaaaaaaaaaaaaaaaaaaggctgaaaagggagcggaagggggaacaacaaaggagacactgggtcctggatttttcttcatctcttcagtatgccaaggggtcaatcactttacctctcaccccttacgaaatgaacatcattatctatttgtgtagaaatgactttaagatccccagacaaaaggcataagggcaggacgccatcatcagagggtaactgccctggacactttccttgaaaagcacgcctggatttggggtgttatattattactacgaatgtagcatcattaaacttaaaggccaaaaagtgatcttacactaatcatcactccactaagtagatgtctgtcatgtcagttagcagaaggaaagacaatcttcagttctacgatggcagagaaagcggtgtgtcattacgccatgacaggtacctgccccggtagctcagatatttcaaaatgaagtagagcttacaaaggagagcatgaggaagcgcttgtccaggggcacttccaaataaatatttccagggcagcctcacagctctatggggctgctgattgcgggcctggttggtttctggaggcctcccagctgacatagagaataaaaatcatgattccttgctggagtataactccaaggaaagctggtcaagctcactcctgctgggagacattcttcaaaggtgtggccttccatccacttcatggtgtagagcagggatggggagagaagagggcctggaggtagtagtcttgacaggacaaaaagacggtcatcttttgataggattgtcaaaaataaagaccgggattaagagtccaaagtgaagcagcaatcaggtgtgtccaaggaccgtgaggactaaagcaggagtctgagtgagaaggtgaggggaagatgcacctacaagatactggattccgggtccggccccataagcaatctgcagaagtccaaagtgagtccctgcccttggttagcatgtagtttgcaggtgaggcaaatgaaatcatgatatagaaaggcatgtgacagccacctgaccagggcacagtcctggtcaatatggtgaaaccccgtcaatatgtgtgaaaccacacaatgtgtgctctgggagcagccgggaccacagtgatcaggggagtggcagagcctgagtgtgtttccactggagatgatgatgggatcctgggacaagggaagggatggatggttgctctggtgatgggataggaagctgaatgccaaagggcagtgagcatgctggtccggccagcagaggaggggagtgggaagggaggtgcactcaaggccaggctgtgcagaggcacacacacgtgcaaagctaggaactctggacttctcttgccagcagtgaggccaggctgtgcagacacacacgcgcaaagctaggaactctggacttaccttgccagcagtgaggcactaccaaagggggctgaagatattttatcacaatagaaaaccaagaaaattggaaaacagaccctagaggcaaaaatacttgaggtaggatagcagcaatatcaacagaaaagaaggacttggtacaagaaaggttatgcagctgatttaacagaatctggggatccaagggggtgcagtggagtctgagttgactccatgattcagaaatagaaacgcttccacaaaaacatacaagcaaactacataacaacaaaatcattcaacaaggcagtttacttgtttgggtgatataaattttcctttcacaggtataatgctagcaatcacatgttccagaatgcttggcctagattggaaaaaaatgtttttggtgtttctatggtgaataagtgcataagaagaaatgggtttaaacaagcagagaaaagaaggaaatgtacacaccagctttaactcagacccacaagcaccaagatcttactgatatattttacagggaggctgaaagtcagggaactgggatctgaagtcaaaaggacatggagaagaaatatctgatgccaggatctctatcagtctggctgaggttgctgatctctattggtcctacgtgacacaattaccaatcacattattccgttacagatggcagctttggcattcacagggtaggaaaaggcctttgttattcagggctactgctttggtttgaatgtgttccctccaaaattcagatgctgaaacttaatggccaatgtggtagtgtttggaggtccggcctttaagaggtgattaggtcatcaaggctcctccccttgtgaatgggattaaagcccttataacacaggtttcacgaagtgttcagcttgtttgccttccactgtgtaaggacacagtgttccttccctccagaggatgtagcaacaagacatcatgttggaaatggaaagcagccctcaccagacaacctgctggcaccttcatcttggatttcatgacttgaacttcccagcctccggaactgtgagaaaaaaaaaaattctgttcttggtgaattaccgtctatggtattttggtgtagcagcacaaactaagttaatacaattattttttaaaaactgatgcaaaacatattactgaacctgaaaggagaacttaacctgcctatttaaattgtatcttagagtaactaaatagctccagttgtatgaattttagctgataaatgtggaatgatgacagaattagaaaaatcattttgcaactcctggagaattattggactgaggggagaaaatatcacttgatgaaaccattagataaaaggatggtaaagaattttacagtgggtggattaacttgtcaccatctaaatccactgatcaatcttagcaccaccgaaggaggacaactagacactaagtgccatccgacgcagaaggaattatttttgaccacccctcaacgatccttgtgaaacaaaacagaaccccacacactgaagctgaatctaaccaaggctgcaaagtcaaatcccatttcatgcaaaaaacaagggacagagggacaagtagagcagtcagctgaatctggggtacgggaaattctacaaaagcccggacccgggatcttcaacaagtcaatcacatcgaaagaaaaagatggtagcgggagaagaatactgtagattaaaagagatgtaagagatgtaacagccaaatacgaggtgcagaccttgtgtatccttactcagccaagacaactgtaaaaacatatttctgggataatccaggaaatctgagcatgaaatggcattgcgcatggaagaaaaaatgtcctcatttttcagagatacaaaactgaggtacgtatgaattaaatgacctaatatctgagatttcacttaaatatagtcagtcctctgtatgcacaagacgttagttccaggatccccacaaataccaacatctgtggatgtttaagtctcttacagtcagcccatggtatcgctgggttataaatccccaggtccagcatctgcaggttccaacaactgcagatcaaaaacacagctggccctgcatatccacatgttctgcatccagttcaatccagcagagatcactcaacgcagaagccatgaatttagagggccaactgtatcttcagcagattttcagcttccagcaatggtggagtagcttatttcagaccaagcagcttatctgctgctgaaaacacgaaatgctgtaaacaggaaaacatagacaaaaaagtatttttaagaatctgtttgaaggtatcaaggagccactgaggcagcaagatcttgaaaagtcaagatcatggaaagagtggaaggtgaaccttgtattcattggtacttttccctttgatgatcttagagacagagaggctcaccagctgagcaatatttttggcagtctcatagaaaaggagacacagaaactggaattcagggatcaacaatgataacaaggagctccagtaaacattcctggctttcgactctgaccaccaaaggactacaatctatctaggtatagtaaattagaaataaagcagccattacaaagaatgaatcacttcaaatcctgattggattaaggtacgaactctttctatcctgattcccagaagcaaaagtaaacatgtctgaaggagataacatcatcctcagcctcaacttatctcaaattttctgtataatgttctgcatttggtaaaattataacccggcatacaaaaagacaagaactctctgaaaaccaagaagaacaatatagacagtgacataagacctacaggtactgaaatggtaaggttctcatacacagactttaaaatagctcataaatatgtttgagaacttaaataatatgtaagaattttagcagaaaaatcagaaattatgtaaaaaataaccagtggaaattttagaactgaaaaatagaaaactaaaattaagaacttaacagtctaacattagattagtcagagctgaggaaagaattagtgaactgcaaggtaggtcaaatgaacatatccatcaaagatacagagacaatgtaacagaaataaacaggagcagaggtctcatatgtgtcaactggaatctcaaatgagagaaaggagagaatggggcagaagctatatatatacacacacacacacatacacacatatacatacatacatatatatacccacatatatacatacatatatacacatacatatatatacatgtatatatacatacatacatacatacatatggctgtaatggcggaacattttcaaaactaaagacagcaagtcacagattaaaaaatgctaagaattgcacagaaactacaataattcagcaaagggaaaaagaagaaggatgagggataaggtaggcgtggcaaaatcttgataagaattactgaagctggatgatagacatatgaaagttcatattattctatttttgtgtacatttgaaaattttcataatcagggcactggattttactttttcacttttagaaatgatggacttcaggagatagcctcaagtttcaaaagatttggaattttactaaattttgagccttctgtagaaataaaatgatacattcaatgaacagtatataacagccttccaatgctgtttcaagacattagacagacatagacttgatagctagaataatagcagagggagcaacagcccacagtgaacattaaaaggcttcgctttaggtcttaaagcaaatgtagaaactcagtgtcatatgccaggagtaaacgggacaaagaggcatgaagaggcacatagagtcagtcttctgatgttccttaggctctgtttaatttaaagcagctgttttatggaagttatttatgcctttgtggtaggataactttattagtaatatgatatatttttgttgctgggagggaaaaaaaaggtcctaacatcaggaaacaaaaccaaaggggaaaaaaaaagatgggccccacagtcatgaaaccacctcagaacacggagaactacttcttaccatgaccttaattcacccaggctgctactctggagaggtgctgtttcccaagtgggtgatgaatcactgcttctccatcacctctactgctgtgctttgttggtgacagggagatcagggccgtgaattcttgtttccaaaagaaaaagaacttgggttccagcccagactgaaccctcagctcttgtttggtttctgatatgtactattggcctcatatcattaagatggatctgcactcccccatctctatgtgagtaacagaaagaaaattcgtggtgtcacacaggatttgacaacatcacagtgagattttatctaatgcaatgaaatttttcttgcatttcttttacttcataaactgagatacatttctacttctcttaaaaccttccaccaaataggtccttcactcaaaaggtggggtttaggccaggcgccatggctcacacccttaatcccagtgctttgggaggccaaggagagaagactgctccagggcaggagttcaagtgcagcctgggtaacatagtgagatgccatctctacaaaaggaaaaaaaaacaatttaactagtcagccatgcttggtgttgcacagctgtggtcccagctgcttgggaggctgaggtgggaggatcacttgagctcaggagtttgaggctgtagtgagctatgatggtgctactgtacttcagcctaagtgacagacaagactatctctacaaataaatacatattttttttagaagtagggttttcttactcttattagtttgacaattaagagttactttgcacatgatccattattagaatctttaatcagataagaataaaagagactttcaattatctgaaatgtccatgttattcagactcaggagcacagagggtaggaaagcagtagataaattagaatgaaggagatacaagatttgggctgaagacatggctcttccagttagttgaatgactatttcacaactaatgtgataagagattggagagcatctggaaatgtatacaactccatacgaacacaaactagtattattaagtttccagggctagtaaatgtatggtaattagtggaatgcactgttgcacccacatggagattacacactgggttgggggtggggagaatcactaaaaaaaaaaaaaaaaaaaagcatgatagcatcaaaatggtcattttccacagccaaaaacaaacaaacaaaaaaacagaaaaccacttgaactactgctacatttgcctgtttcttttaaaatacaaggggcttgggcagcaacacacaggaaagcctggagtagttgagatgattctgggtgagtgtcctcattaagggaaagacttatgttgcagataggactaagcatccaataatgaaccaaactggggttttggtctttccttctagaaaacacactgagaaactcttgcctatatttgtaacttttatattaagtgtgttcaattattttcacttcacactggacttaaaaatttcctcactctcatgcccgcgagcagcctggctggcagcagggaaacctcaggggctgtgtggatggccctcagtgtggcgcaggggtgaggactggccagcatcttccaggcaggcaggacagtcctccacttcatgtaaacagtttcctcttgaagactcctaacagtgataatgctgtccttttgcctgtctcatatatgacagcactatttttttagagtgtgaaacatttgatgacatcttgaaggatttcaaaaaggctggctagcacaactgaagtataaaataaccataatttagtttaatacatccttgagaaaaaatggtaatgagatattccctacaaaaactgcatttattctgtatagtctatccttgtgtgggataaagttctgaatgtacacactcaagccctccaaagatggtcatatcattcagatcattcctcaagaaacttaacagcagaaagtttaaaattttcagaaaattttaaatttatttgaacgttttagttcaagtttataaaagttggtttatattctactcctagaaatgcagcaggcatggtagctataccgattcaatgggagcatactgaaaacaatgtagaacgctcgatgaaatattctaaaaagcagtaagatgctggcaagataggaaggcattgtcaggccagaatgtgagtgaagaaggactcctgacaaataagcagaatagctgaactgctggtctgctggagtctctgtcctcctctgctctgtgggacttgggggacaaaagagcaagcccactgtctccccagcaggatggggtctagtaggaaatccttcctttcgttcaacttatttggaatggtaagtaagacatgattgccggtaacagaaggaaacagattacatgcaagagtcccagagagctgacaagcagttgcagagtggaagctgaaagaaagccagtggaatgacatcttccatgttctgaggaaaacaaactcctcctctagaattctacatcccaaaagacatctttcaagaataagattgaagagctgaagggtgcagggcttctgatgatgatgaaaatcttctgaaattgactgtagtcatggttgcacatatattaaaatatattgaaaaccactgaagtatacactttaaatggataaatccctctccctctccccacagtctccctctccctctctttccaccgtctccctctccctttcccacggtctccctctccctctccacggtctccctctccctctctttccacggtctccctctgatgctgagccgaagctggactgtactgctgccatctcggctcactgcaacctccctgcctgattctcctgcctcagcctgccgagtgcctgcgattgcaggggtgcaccgccacgcctgacgggttttcgtatttttttggtggagacggggtttcactgtgttggccgggctggtctccagctcctaaccgcgagtgatccgccagcctcggcctcccggaggtgcagggattgcagacggagtctcgttcactcagtggtcaatggtgcccaggctggagtgcagtggcgtgatctcggctggctacaacctccacctcccagccgcctgccttggcctcccaaagagccgagattgcagcctctgccccgccgccccgtctgggaggtgaggagcatctccgcccggcagccgccccctccaagaggtgggggacacccccacccggccagccgccctgtccgggaggtgtacgcagcaggtcattgagaacgggccatgatgacgatggcggttttgtcgagtggaaggggggaagtgtggggaaaggaaagagaaatcagattgttgctgtgtctgtgtagaaagtagacatgggagactccagtttgttctgtactaagaaaaattcttctgccttgggatcctgttgatctgtgaccttacccccaaccctgtgctctctgaaacatgtgctgtgtcaactcagggttaaatggattaagggcggtgcaagatgtgctttgttaaacagatgcttgaaggcagcaggctcgttaagagtcatcaccactccctaatctcaagtacccagggacacaaacactgcggaaggccgcagggtcctctgcctaggaaaaccagagacctttgttcacctgtttatctgccgaccttccctccactattgtcctatgaccctgccaaatccccctctccgagaaacacccaagaatgatcaataaatactaaaaaaaaaaaaaaataaaaaaaataaatggataaattgtaagctgtataaactgtctctcaataaatctcttaaaaaggataaagatgaaataaaaatatctttagacaaagaaaaattgaaaatttgtcaccagatcttcacaaaaggaatttctaacattttagttgaaaggaaaatcatcccagatggatggtctaagatacaagaaaaaatggacaaagagaatgcttaatatgggcaaatctatgaatactgacaaaataatttttgtgggttaaaatatggtaaaaattaaaatacacaacaattatagcatatgtatcagtaggagaaacagtagtattcaagcgttttaaagcctctctacatccacgaagaccgtaagaaagtaacatactttctttacaattctttaaacagttcatctgtgacttatatatccttcacaatatgtgatttatttaataattttaaaagtcttaattaagactttttaatgttctgtttaatgtaactgatttaatgttctgttttaatttctgagtacaaagccagtttgcggagagcagtcaggttaataggtaatctagggatttaacgatctcaaagattgagtgttacatcagtaagaaaggagcattgtcgttaaaaaaaacccataccttttccttgtttggaaagaaaagaggagagtcataaaaattaaatatgaataaaaagctgcacaatttactttaaaatagaagatgaaatatagtttggcatcaatgagcttaccaagccgtatgtatctgtatctacaatgttgtttaacaaccctatactcatgtgatgttgttgacatagatttcagtagtgttactggtactttattgaaatcaatcactacagatgccaagtactcagagcccacagaccttgaagaagtcataggatgggtttccatagcacaggtgttggaaggtgccgtattgtggtgctgggaagcagagatgttctcttctttgaagattttcaaagaaaaaatatagcctgttgtagcagagcagctagcactgcttagatgcagaatcatgagaaagtgaggcgatagcagaggctggtaaactccacctcacaagccaaatcccatgagcaacatgcttttgtaaataaggtttcgttgggacacagccgtgtctattcatttacatattgtccacagctgctttcaagctacaagagcagaattaagtaggaggatgtatggcttgcaaagctgaaaatatttactacctggctcttcacagaacagttgctgacacttgctctacgacaaaggagttactaaaaataagaggccaggaagaggatcccttaaaaaaatgatcgtaatggacaaccatgaataggtctgggaggtggggctgcctagttgtctgcatcactagtaagaataatggtaattacagtaacagcagttcatacagttagtgcctttgcctcatgtcaggcactgtcctaaggactttgagttgaatttattctaaaaaaaaaatcttattcaagcagactctggtaatgatggtgtaaagtaattagtagttcttgtccatagaaaatgagtacaaaactagtcaaaattgccaaaggcaaccactttagggcatcagaaattgatctaaggtagacaaaaaattgagaagtgtttatttttttaaaaataactatattttaaggtaagaaaatcaggattctatggtcttcttgcctgaggctattcccatctaccattcacccccaagtcagccttagaaggaatgagaccaactctccgtatcacctggataactgggaaattgcatgtacacaagggagacccaaaagaacctcatcaaaagtaaaaatcagaggagatttgaggaccttaaatgtatcttctcacacacaagtgaccagcagagtggaagccttataggctcaaggtatttcctagaggtccccctgtgtcttctgcatagcttaatggtctgcccacatcacaaaaaagaagaaaaagaataagacactaagcaaagacaatactgatgagctccactgcgtactccacactctgcagctgaagtccaagcaagttacaaaacaatacaccacaaaatgctcaccaactactctcagaacaaaacagaatgcagttataacacattatttaaaatgttcagttcccaaaccaaaaccaccagatatactgtctctacaccctgcccccaccccccaaagaaataaagacagagggcaggaaaatgatacaaagtgtcaaaagaaacaaactattaaccgagatacctatatccggagaaactaccatttaaaaatgaaggtgaatatagtaaagatgatgagtctctttaaattgacttagtgaaactgtaataaaaatccaagcttgatatttgtagatatagacaaactgtttccaaaatttatatggaaacacaaaggaattacaagagtctaagcaattctaaaaaataataaaattggagggctcacacaatccaattttcagatttactagaaagccacagtaatcaagacagtgtggcactggcaaagagatagacacaaaatgaatggagcacaatagaaattcaagaaattgattcacacaaatgtagccaattattttttttttcccaaaggcataagaacaattcaatggagtaaggatggcatttttaaccatcttcaacaacacctgttatctaccttttctattatatccatcccagtgggtgtgaagtgctatctcactgtggttttgatttgcatttccctaatggttaataatgttgaacatcttttcatgtgtttatcagccatttgtatatcttctttggaaaatgtatagtctagtctaggaagaaaaacgaacttcaacctgaacttcataacttatatatcaaggtcaatgatgaggccatgaactcaaatagatcattgacctaaatacaaactcgtaaaaattttagaagacgtaggggaaaatcttcatgaccctgagttaggcaagagttcttaaatatgacaccaaaaatatgattcataaaagaaaaaaatggaaaaatttcatcaaaattaaaaacatctactctgtaaaagatacatttaaaaaatggaggcctggcgtggtggctcacacctgtaatcccagcactttgggaggccgaggcgggtcgatcacttgaggccaggagttcgagaccagcctggccaacatggtgaaatcctgtctctactaaaaatacaaatattagctgggtgtggtggcatgcgcttgtagtcccagctaattgagaggatgaagcacaagaatcacttgaacccagaaggaggagggtgcaatgagccaagattgggccactgcactccagcttgggtgacagagtgagacactgtcccaaggggaaaaaaaaaaaaaaaagaaaaagaaaaagaaaatggaaagacagcttacagagtgaaattatttgcaaaatatacatcagattgaaggcttgtatccaaaatatatcaagaactcaataaaacaaagccaaaaagaaaaggaaaagaaaaaatggtcaagagacttgaatagacatttctacagagacaatatatgaatgccaaatatgtacaggaaaaaatgatcaacataattaggtaccaggaaaatgttttccaatgagcaccaccacgtaccctttaccacaggtcaacaggctagttctccatcctccctctaaaccaaatatatatgacttctcccagattgtggaagtatatatgcatttcctatgcttaattagataatcaaatccctacttagagctcaaattactcaaattactcaaattacaagttcctttagtcttgttcctagaggtgcctctgcagctatgaatcttgttttatacttatcaacttatcaacttgtaagattttgacagtttttggctaaaatcaaacaaactatcaatactattcttttgtgtttgtgaagatgtggaagaactggaaccctcatatattgttaataggaatataaaatggtaaagcactttggaaaacattttggcaattacctaaaaagttaaacagaagactcgagtgagatggtcaaaagatctgactagatatttttccaaagaagatacacaaatggctcataaacacctgaaacgatgctcaacatgattagccatcagggaaacgtgactcgaagccagtgtagtaccacctcacacccactaggatggggataaccaaaaagacagataataacaagtgttggtgagcatgtggagaaatgagaaccctcataccctgctggtgggagtgtaaaatagtacagccactttggaaaatgatctgtcagttcctcaaaacattaaacgacagagttatcatatgacctagcaattctacctctaggtgtgttcccatgaaaaatgaaaacacaagtccatgcaaaaacatgtatacgaatgtttatagcagtgctattcataatggcccagaaatggaaacaatccaaatgcctatcattttataaataaacaaagttgatatctccgtatggtggaatattattcagccatgaaaaggaatgaagtgtttatacatgctacaacatggatgaactttaaaaacattatgctaagtaaaagaagccagacacacaaggccacaaattatatgattccatttatgtgaaatggtatatgacaaatcccgaataggcaaatccacagagacacaaactagattagtagtttccatgggatgtggccaaagggggttggagatgactgctaacaagcatgaggctttttttttgcatgaggcaatgttctggaattaaattatggtgatggttgtacaaccttgtaaatatgctaaaaaacccactgaaatgtacacttttaaagtggattttatggtatgcaagcgctatctcaatttttttaaagattaaacattatgcccctgaattccattattaggaatcaatctacttatgagaaataaaaatatatgtccatacaaggtcttatatgtgaatgtttacagcagcattactcatcatagccaaaaaagtggaaataacccaaataatcaactgggagtagataaatatgatgtactatatccatacaatgtaaactactcagcaataaaaagtaacaaagtactaatacatgttacaacatgaatgaaccttagtaacatgctgagtgaaagaaagcagtaaagtaaggctacatatatgattccattgataggaaatttgtagaaaaagctgaactatggagacagtaagcagaaatgtggttacctggagctgggtatgggtatgaactgactgcaaacaggcctcaggaaaactttggagatactagaaatattctaaaaatggattgtgagaatttttgcacaaccataaaaacttctaaaactcagaactgtacaacttataatggttgaattttatgatatgtaaattatgcttcaataaagctgttaaaaattaaacaaccttatgagacagatactattattgttgccattttagcaatcaggaaactgaagcatagacagattaagtaacttgctagaaaatggcagagctattatttgattccaggcaaaatgattacggaattcttaaccactaaatcaaatccagtgtaatttgctaactataaagtatagtactgggaaaattgagaaaaatgccaccttcttccaagagtcaaagaatgatcacacattgagggcactatttatatacctaactctctgcaagtaaccccatttccatcctctcttattagcacaccaatttgcaaggtagttgctattacattaaaaatatacaatttaaaacagttcagcacatgtgtcttataatggtctcctccaaattccatagcgaccattaaagaaaatatgtctgggccaggtgcgctggctcacacctgtaatcccagcactttgggaggccgagcactggggtcaggaggtggagacaatcctggctaatacggtgaaaccccgtctccactaaaagtccaaatttagctgagcgtggtggcatgcatctgtaatcccagctacttgggaagctgaagcaggagaatcacttgaacctgggaggcagaagttatagcgagacaagattgtgccactgcactctggcctggatgacagagtgagactatgtctcaaaaaaaaaatattaactaatcaaaattttttttaaaaaagaaactatgtctgatacctacgcattcagagctttctttgctcaggcaccctctcctctcacagtctctgaaggccaggcaaaaaggctagttctttaccctccctctaaaccaaatatgtatcactccttctacattgtggaagggtatatgcatttcctatgcttaattagagaatcaaatccctacttagaggtcaaattactgtagttcctttaatcttgtctccagaggagcccctgcagccatgaataatcttattccattcatacttatcaacttgtaagattttgacagtttttggtaaagcacaaacacatagccataagtactgctcaagcagtatttttcaaagggaggaagaaagggaaaaagatgagggaagagtaaacgttcatgaaaagaaagatttctcccctttgggaatctgtttattttgccattgtcaaagtgaggcaggaattcaaacacctgacggcatggaagtggcaaaaccatgtgggtttgacttgatggtcctgagaagctgctggcaatgctttttaaattctgcaaatataattaatggcttgtttgctattttggcaacttaaagcaggggctatgactgcctgtgacaaaatcagtaattgaatgattaaactagatactcacagtcaaaacggcatctaacaatttacctctaatacaacattcccaattaatttttaaatacctattaagatataaaaagatttaaatataaaaaaattaaattcaacttaaaacactttaaaactagggccaatgcctgagtctagaaagagactacctaatgccagagtctaggagttcttctgagccacaattttgctgagggcaatgcatagtgaaacgctatgagggtaagactgcctggctgaaaagagtgacaaggacccttcacactgtcagaatcatggatcagaaatcaagtctgcaccaagcaagaatctgcacaactgtctgtgcaccatgtggggctggcttctacagcagacatacgcagtcattttggtccctctctcctcagccaatatgtttattccatatacagactttaacttctgggaaaatgcagggtagagagtggagagaagtggcaggaatggtgtcacattgaatacgggcataagcaggtatcatacataacgtgataagagaaggctgagatatgaggagccttcacagaagtacattctacagtattcagttttcaaggtactttgtttcatgtaccagaaaagcaagctaagagaagatgccatttcagtcaaccagttcccaatagataaaaatacactggattgtgagaaccagctgtagactgagcatatccatctgttgtccagttacagatctgatgagggaatccaaagagcactaagccaagggcaacttgtgtaccatttccaccagcaaacattaatgctgaatgctttcacactaaaatgggagaaaaagcaaggatggctgtcatccatactcatattgaacataatagtggaagtactagccagtgtaataaggcaaaaaaaaaataacaggatatagaatagaaaggaaaaaataagctgcccctatttacaggtaacatgattgcctatgtagaaaatcccaaggaattttcaaaaacatttctagatctaataagtgaattaagtaaagcagcaggacaaactcaacccacgtaaattaattatatatctacagactagcaagacatacatgaaaaccaaaataaaaaacacagtaacacaaaattacttaggtatgaatgtaaaattgaatacttagatacacacctaaaaataccatgtacagtatctgtatgctaaaacatacgaaacacagatgaaagatctaaataaataaagagccacactgtgttcatgcattggaagactcaacacagtgaagttgtcaattctctccaaattgatatataggccaaacaatttctatcaaaaccccaggaagagtttttgtagctatagacaagagtattgtaaaattagcatgcaaaggcaaaggaactagagcagctagcacaattttggaaaaggagcaaaactagaggattgatgtgatctgatttcaaatgtttctagagaagtacactactgaagaccagaagtagcaagcactagttctcatgctaattctgcgatgttcacttaccacactgctgccctgtttccagttttccactgtactttggaaaagctagtttggaagtgttgcaggagaggtatctaagcatctatgtatggcaaatggttgttctagtcatctactgctgtgtaagaaaccaccccaaaatgtagtggtataaaataataaccattttcttatggtcacatattctgtgggtcagaaattcacgaaggatacagcagggatatctcccctctgttctattatatctgggcctcagctaggatgacttaaatggccaagggtgtctcaaaacagctgcagctcaaagatctatttccaagatggcttcttcattttcacctctggcacctgagctcaagtgaccaaaaaatgaactcaagcagggactatcaacaagagtacttaagtggcctctccttttaggttctcaaaacatggcagcttggttctaagagggaatgtcacaagaatgacctttctggaaagccaagtgttgccaaggaccaaggcagaagctgcaggggttcatccaccctagccttggaagtcgcattgattcacttctgctgcattctagcagttacaagagcttcatttagggaaaaccagattcaaggggagggaatttagactgaatttttttttttttttttttttttgagatggagtcttactcttgttgcccaggctggagtgtagtggcacaattttggctcactgcaacctccgcctcccgggttcaagggatcctctggcctcagtctcctgagtagctgggattacaggcatgtaccatcgtgcccagctaattgttttgggttttagtaaagatggggtttcactatgttggccaggctgacctcaaggttggatcgggtggatcacttgaggctcaaactcctgacctcaagtgatccacccgcctcggcctcccaaagtgctggaattacaggcatgagccattacgccaggccagactcaattttttgatggggaaatggtaatgttacattacggagaatgtggaggaggagatattgtagtggacatcttttgaaaataccaattgtcacaatggttacagtaaaaaaatacaggagcatttaaaaaaaatcctccactaaagtaatttccactttatccaggtattatgttataacctcagaggctctctaagtcctttcaatcaacagactaagtttttatcactcacatggaaggttctattatacttgcagatgcaatactgtgcctttcacatgctgcccgctaggtgctcaaaaggccaaagaagcattaatttacactcacttgcctactcccaccttttgggtgggtgattcctcaccataaggatccctttgcccaacccctccccatccccttggtgttttctttcaagagacagggcacctctcccccagagagagagcgagcgagagagagagagagagtgcgtgagagagtgagaaagcgagcaagagagagagcaagagagagcgagagacaggcagacaaggtcttgctctgccaccggctgcagtgtagtgctgtgactatagctccctgtaacctcaaactccttggctcaagagatcctcctgcctcatcctcccaagtagctaggactacaggtgtatgccaccatgcctggctaattttattttttttattttttgtagagatggagtctccctatattgcccaggctggtctcaaattcctggcctcaagcaatcctcccatcttggtcttccaaagtactgagattacaggtgtgagccatggtgcccagccagaattttctaagagccttttaggatgcagctataccacggttacatttattttaacttgtagaagttttgctttttttttttttttttaaaaagcaatcactcttggagatactagatactacaactattacctaaaaacttaccatgataactagttgagaacaaagctttgtaaggataagcactgagttgagttggggtgtggacgggggggggatggtggcaacagaatattaagaagaaaaagaagcctacggaaacctgggtatgatatcaaaacaacaaagattatactacctaataaatgtaagtacagtaagtatggcatctttatacaccacaagccaaattcacatccactacttcattgattaaaactgtacagtttatcatgttgctaacgcaatgtagaacccaaagttccaagaggcgaggtgatttggccaagtcttcacggcgtgaaagggctgagatcggaactcagcctgtgcttcctgaacccagctctctccagccatctcattgcctcactgaacctcacctaacagtcatgtacgttgttaacttcttaactgaaatatttccaatcaatgcaagaaccctaacacactctgagaccactgagtacaaacaagctggcagcccagcatcacccgtcccacagcgcccaccaggagttcacacgtgaagcctaattcatcccttaaaaaaaaaaaaaaagtgttagaaaaatgtgaaaccaatgaatctgccagcatggttgtttcacatagaaaatctggaatccagcatctaaataaacggtagaatactgttgctaccagctgtgattccatttaagacaccatttgtggaaaatatttattatggtcttccattttctcagcacaaaatcaaagaaaattgagaaatatgaaattacattgtcttcaaaaatcctgtcatagagtaactcagctctcacagctatcctctgaagatgttattgatgttctaccaagttgatggagtaatataatttgctagcaggaaaaaatgctggcaaacagaattgtgttcattagagcggtatctttacaacgccttcttccactttcattacttttcaagatcacacatcatgtcacagggccgaaccacagccttgctatgccctggatatttcagtatttttttacagttggaagcagattcttaacgcttgtgcaaattacagctatttttgctaaaatgggctcatttatgctgctggggaaaagaagcctctctgtctccctctctctgaaggtctatgaggcagctctttacatgtagctcccattacttcaggctcgtaagttcccgcgggggcagtctcttccataaccaatcatcagacctagcgctggaccagttcacatccacactgtgaagtaagcatcgtttgtctttactccctttccatccctcttagttctgacaagttttctctttcacttgggctgaaggactcaccaacggccttcttagtgtggcctcacaaatgctgccttctccagagcagctttctccagaagttccctctttacccagtcaaaacttccaagcctcctttagaaaagtctgatcccatcagggtgttaaaaaaaaaaaaaggcaaccttattagatgaaattacaggtgttaatgattaataatttcatagatgagtttagattttgagggagaaattcttatcaactcaaaacaatttttaataggtaaaatttgaaacaacacaactacgtgctgcattttcatccgtgggaaggaaaaggatttttgggcacaagcgactcccagattcctcaaaagcaaaccacggagagttgagcttcatgtgtgtggtagaggttcaagcacggtatagggagtcgactttcgaactgggcattgtactggtcacatgctcaaccttgctgctgaagtgtcctttaaatcacttagtcctgggaagcaaatgcaagatgcatggatgggacctgaccagattagcacagggaacagggcaaggagaatggtgagcagattaacacagggaacagcgcaaggagaatggagtctagattagcacagggaacagggcaaggagaatggagtccagattaacacagggaacagggcaaggggaatggtgaccagactagcacagggaacagggcaaggagaatggtgaccagattaacacagggaacagggcaaggagaatggagtccagattagcacagggaacagggcaagaagaatggtgaccagattagcacagggaacagggcgaggagaatggtgtccagggcacctatgaagcattgcttctactttctgagctgctggaatagactacaagctttgtggtctgcattcctctacttctactaagcgttcacatgactcgggaggccagatgttattcctggctcatgcctactaggttaaaggagtgggggatgctttacttccaattattgaaatgaatcacagactgtttagagccagaaggaagcagagatcacctgcttcaaccctgtcaccttaaagatgatgaaatagcctagaaaagttgccctaggcccactcaggccatgcagcaagctctaagcccctcagctctatcaagttgggtacacaaaaggtgcttaataagtgttggctagcctagtggctggattcctgaggtctgcttcctagttccatgctcctttcattataactccctcccatgcccaccatccccactcccacattcttcgttccagtctctggtggaaaacaatcacagaccatgccagagtccagaataagaccccaaagtgagttaggggacggtccacttactcagttacttatgactctaattatgtgccaagtggtgccagtgtgccactgctaattattactacacaggcttcagaaactgggccaattctttcttccttccaggaggaggtttggactaggggaccgagaaggtggctctcaggaaagcattccgaaagtttctctatcacggagtatcctttgaaggtgaagtcaagaactcctcttggaacacggcaccaggagcttttggagtcccggatgcttgcggatgactccccttaatgaaatgtaggtatgacaaggtgtacgtggcactaggttcagaccatgataatgtgccatttcggggacctgaattcctattatgatgtaagtcctttcagagagactttcataggcagctccctaatgaggcaaaggtctccgtagctcctcacgtataaatggaaagttgttgcacagaggaacagggccctttctaaccaagctagcagggacaggaatggcactagaacccagtatatttctgcacagactcaggatttttaatagtctgcaatacggcaagctgtaagcaaggaaatattccaataaaaaaataaaatacagactaagaagaaagccacagtcaatatttgattatagaattcaatgaatgattggggtaatataaacaggggatgacccccaaattcttgatgttggcctgaaagtattgtttttatttatatttaagtacaattgtgtggtctgtattctggaaatttccttgaaactaaatattggtgccaaatgaagtccacagagaattttataagctctatattttacctatttccaccattttccaattctcctcaacacgaatagctgacttctttcactgctcccaaaacattgttgggacaaagatggtctatgggttaatggatttccctgctcaggctttgtactttctagctggcaattatagctccttacatactattgattaaagaaaaattccatctctggtgttgcatccacctttggaaaagtgaaactagaattcattgaccagtttgttcatttatttgttcattcattcattcatgcattcacattacagattccacatttactgagcacccattatgggccagacactacagggataagctgggaaataagggagaccacggttcctgtcctcatggatcttacatcactgtggaagggccagatactggaaagtattaacaagtctggtgagtactgggcaggcttcaaaagggacctacagtagtcagagctgctctagagagtcaggaaaaacttagaagagacactttcattgggggctggtagatgagtaaaaattaggctgatgaaaaaacagtaggtggaaaacccccaggggcacaaaacagcaacactgagaattcaacgaactgatggaaagtcaagagtgtcccaactatagaaggagagctgcagtgaggaatgaatgaatgaatgaccctacttgctagattagtggaatcaaccccagtgatgaatggggcaacacgggcagagcccactcttatctacccactggggcactaggtccaagtgaggggagaacccccagagtcagggtcggcaaagcttttcgagggcagcatctgcaccttgagggcaattgtactttctatacttggctccaaaccaggcacacagtcagcacctaaaaaatgtggatgcttttagaaaagacagagtcacaagcacataattagagaaagcctcttttggtcagagggagagcctcatttctgaagcaggaatttctgccacagataagccacaatgggggatgagtgtactctgtgattctttggctaactgaaccatttgcatggacactgctaattttgggaaagatgactgaacagctttatgggtcaaatttgagactgagttgtagagccagatttgaatccaagactggatgactctgttccatctaatcatcaggctcattcatttccagataaaatgattttttttctgcttactctgctttcctgagcaaactgtacttttcagttgcaaaatattacatttacctcaaagcccagggaaaataaaggtaggtgatacaaatgacccttttttgtgactgtggatgtgaatttggtctctgtcctaagaaatgatgtgcaggaactggggagaaaggaggaggccatggtgaagctcaccacccaggctgcatgtcttcaataagctacaccatgaaaaagctacatccctaccagacaagcaattcctcccctggtatccaaggtctcagtgatttcatcaagctggccactttcttcttcatccacatgggatacctatactaaactactctgggcatcttatggggaataaaatcagttgggggaaagagagcctattatgttacctaggaaaagagatctggcaagtatgagatgctttccaaattcctcttgggcactaaagtactacttgcaacacttattaatgcaacggatcagtttatcctgctaacaccatgaggataaattgcaaaacagcatatggaaatggcaggagtctcaaactcagggcatggtgacactgtgtctctgctagtaatcaaggtttacgtgctcactgtctgtgtttttcttgaacagagctgtggagcacgggtcagccagacagattatcattttctgtaagtaacaagtttatctacctcttaggaaaggaatggggggagaggacgggagaaagagagaggggggcagacagggggcctgtgcatgctcatgagtacatcagtcggtatttgttctgtagaaattcaatttattcaacaaaaattctggtctttttagccttcagctagattgtgtctgatacgcagaggtcacatgtgtttggaagccactgaaaacctcctcctcttgccttctctgatttctgtctctagaattatcgctgcctttcttttctctgggccactcccttccccattatcagctctcctctcatgctttctggtagttctcactgtcatgccaatgacagaccatctgattagactgttttaaacattctaattttaaacttgtgtgtgtgtgtgtgtgtgtgtgtgtgtgtgtaagcggtatacgtattcccaaaaggctgttcgatgaaatttgatttatgtcctctttctgggcttactctcaaatatatatgaaagagtgctgactttgtacctagagggtttacaactgagccaactcattcattcattcactcattcatttattcattctcttcaaggaatatttattgagaacccacaatcagccaagcactcttctagatgctgggtaccgctctagatgagtgttacctcaattaatcctcacagtaaggtaaacattattactctcattttacagatgacaaaattgcatctcacagaacttaaatataataattggcctaagccacatagctagtacactgcaaaactgctctgtatctaacttggatctttttaagatgctctcaactgctagcagatagggattctcttggtaatcagattttgtaaattaccatgcctaattctttatgccacaatagactccaaaaacagacttattaatgatgacagactatgggcaagattctgatcactttgagaaaaagacagaaaaaaaatttttttattccacaacttctcagttagcatggaattctgacattccatttgtttatccactttgggggtgtcatgataatggggaacatagtccatcaacatatctgtaagctaggacttcattaatatttgttacaatgaacagataaagttgtctatcgctaacatatagcttctttacaaacagtagctctaatcacagttaagggtgcagacatgatctgcagggtttgggtggacgaagggagagggcatgagggacgacgtcgaagttcaaagacaacgaagtctcctcgggattttatgctggctcagctcggtcatctcagtggctgctgccatccagtaccataatgatgacaaaatatgctctcctaagttataaaacactgtgctgaaagtaagaatctctgataaagccttgagtttcagaagacttgcctcctgccccttactgcatttctagttagaaatatcttccatataggccaggcacagtggctcatgcctgtaatcccagcactttgggaggccgaggcgggtgatcacgaaatcaggagatcaagaccatcctggctaacacggtgaaaccccgtctctactaaaaatacaaaaaatgagccgggcatggtggcgggtgcctgtagtcccagctactcgggaggctgaggcaggagaatcgcttgaacccaggagacggagcttgaagtgagccgagatcgtgccactgcactccagcttgggcgagactccgtcccaaaaaaaaaaacaacaaaaaaagaaatatcttccatttaaagtttcacttgcatacttgcatgttttcccgctggcagacagagtgtaacaacactaatttgaccatgctttccagagcatggcggggcaggaatgaaaaccgttgtagccacttcctccctactgccaaggctccggcttgcttcgtctctcaaatctccacctgtcactctgtaatgaatgccacccagaggtccacatctcattttacccatcagtagcacacactactgtttaccatcactttcttcaaaacaggcccctcttggtctctcaatccctgccctcccctgctctgcccagtgcccccccaactgccctcacctctatgctgtacccgccacacctctcaaaccttgccctcccatccatatagctattttctgcagggaccaaccatattagcttaggctaacgtgcaaatccctgaccatggcccacagccccacatgacctggttcatgctttcctctcttttataaagagttttatctccacaaatgcttcatctgccctaaagtctatattgtttgataatgacagttaacccagctttcctctgattaatgtggtcttgatatatctctatttcatctcattatttttaaccccttggtgcagttttcttcttaagcagcatgcaactgggcttaaaaaaaaccaaacaaaaaacctgtctcttaatatttaaatttcatcttaatcatttacatgtatggtgatatatgtggatttatactctccttatcatttttacctagtattttagtttcatctttcagtctcaacacagggaaagcagttgtgttcacattcattagtaaattctattttctgacatttcagcaatttctatactcaacactgttctacgcattctacaacttctctctgggtttacttttcttgtaatacacattctttttaaaaaattattttaacaagattccttgtacctcttaaaatatctttatttcattttcacttttgagagacagtttaactatagacagaattcttgacaattctttgctttcgcacattgaagacattccacgtgacctgacgtcactggctgttgagatgttctctcaatcaaattgaaatcaggttgtaagattctctgccagcgatgttctgaagattcactagtgtgtgtgtatttacatttctttgtattgataccactcagtacttgggggtatgctttgaatttgagggttcatgccttttaaaaactctgtcaaattgaaaatttgctggtcattcgttctactctttcttaaagaacttcttattagaaacttattggatagtctcaaaatatccctcctgcctcagctgcttttgcataattttaaaaaatgtctttttcctctgagctgcattctgggtaaattcctcaccactatctcttaattcaatgtatctttgtgggtttttttatttcaatgactatagttttcatttctgagatttctgattggttctgttcctattctcctgttcttgtttcacatatgtttgtcccccaatcccagtggatattatccatttttttctctttaaggatttggaataaattgaaaacttttattctataattttatttccatatggagtgaatttctgattgtgaatctcagtggttctctttttgatgctctatttctttatgtgttttggcatttaggtgtgcatgttcatttcagtggcaggttctctcccatctgtctctgtccctgtctccatttgcatcctacccccacaagtgcctacgccctcatcttgaacaggatcttaaatgctagctcaaggatcctatccccagtgatagggacattgcaaatccagtcactgaaccagcaggtggcttggctcaggccctggtcaggatcctgtgtctgggatcttatacctccatagactcacaagcttcatgtcgaccatcattccaggcataggtcagcagttacttttatcagcctcccatcatagtgaggatgtcctctctcatttatcaacatccccggttttcagtagtgagcctgactccacttcccatttcacagagtacatatctagtccctgttacattccaggagccaaattcccagccattttgcctcctttatccgagagccaggtagccagtggcttcagctccatcacttctttgcatttctcttctttttcagattcactcgctttgagcctagctatatctttttaatttcccattgttatattttgtctcttgtggcctaaagcatgatctaaccatgccagctcaccaaggagttccctgactttctctacaacctcacctcatgccacgggcccatgcgctccagtcacctcctttgctatctcttcagttctctggtcaatcaagatttctcccacctcaagaccagacacatgcatgaagagaaagagccaagcactgaacgctcttgtcccctctctccctaaatactattctcggccttttaatttcagcttaaatacagtctctctccctaaatactattctcagccttttaatttcagcttaaatacagtctcagaaggcacttttctgatcactctatcttagtaaccctatctcccaattgtttattaattggatccagttagttgtcttcagagcaaagttgcaaacagtcacaagatcgcccaaaccacagcttacaggccacacttctttttggtaagatgtacctacaccactaacattgacagtggtgctgcctacaaatataaaggtcaaggatatgtacaggtatggcccaatgtgaaagacagcagacttcttgggttgggaagtctgagtttcttttcaggactcagatgatgaaattacctggaacttaaggtattatgtccaataatcaaatagtctcttgtttcaatattttatcaaaaataaaatataataaaaccttattgggacgaattgggatgatgaaacatccaaattaatggagatttggaattctagattttttttttaataaaatggagactgatttcttgtaaccctgtacaacagcacagagtaatggtttacaggacactgccaaatagagaccctgccaggacctactttaatgaacagtaaagaactgtctatgatcaactatctttttagcggggatagcatgctgtaaaggcagcatgaatgggctagcatttcccctataatttcctacatatttatgattttcacaggaaacaatttttttccatctacagacactggaaatgtgagtatcagctctctctctacagtaccataaattcaaaatcagtgaggccagatcaatgaaatttgatacgcacaaaactcttgcatattctcatgtgagtgtggaggagagcagagtgtcatcaagactccactccacagccatagtctccgcatctgcagttagctcttttaggacagctagatcactgctccattctattagctccaaacatactgcaaccacctgttgaagctgggaaggctcagcatttttttctctttctcccactggctctgcagaaagcatcacaattccaattagtctgtcaaaaacgaaaggccatgacttaaggtgcaaaacacctatgaaataatgaatttggaaggacaggaggagacatatctgtaccggttagtgtactcaagaatcaggctatagaggaaattgcttctttggtagtgtaaatacaaagttttcaagaatagttactacaaggcactttctattcaagtaccaaattgtgagatacagaatatgaggggatttggtgaatgttttcctttgaacagggctttacttcaggtccatacccaaaggaatatcaatcatgctgctataaagacacatgcacacgtatgtttattgcagcagtactcacaatagcaaagacttggaaccaacccaaatgtccaacaatgatagactggattaagaaaatgtggcatatatacaccatggaatactatgcagccacaaaaaaggatatttcatgtcctttgtagggacatggatgaagctggaaaccatcattctcaacaaactatcacaaggacaaaaaaccaaacaccacatgttctcactgataggtgggaactgaacaatgagaacgcttggacacaggaaggggaacatcacacactggggcctgtggtggggtggggggagggggtaggatagcattaggagatatacctaatgtaaatgacaagttaatgggtgcagcacaccaacatggcacatgtatacatatgtaacaaacctgcacgttgtgcacatgtaccctagaacttaaagtataattatatatagatagatagatagatataaagaaaagaaaagaaaagaaaaagaaacggccaactctaaggagatttcaggtccactgcagacgccccctactggccggttttcaaagctatgccaagacatgtcctctcaattgcttccgggttccaaaaaaaaaaaaaaaaaaaaggtggatcaagacaccagcgaggctcattgcttgtggtctgcttcttatgtgttctagggaattttattttcaaaagctacaaagcttttcacaatatgggtttgaggatgctcagtacgtgagaattttgggttgaggtacagaaaccagataaagccttgttcatttgctcattcggcatcaacgtccagtgtgtcccaatgtaaatgaatcactgtctagaaagtagaaacattcttatttttttttttaaaatatgcaactcttggctattactggctatttcatattccaggaaagcacagaggattctgcactgagctgctgcaggcgagctcactcctacccagctccttagcctggcctgcgccatcacccagtagtgcctgtgtcgagctggtctgcagtccctgagccccttccctaccctcaaaagaggaagcaatttccagtgggagccagagcggccccggcccatggggaagggcagactgagaagccttctgagggaaggatcttgacctgtcaacacacacacgcgcacacacacacacacatacacacacatacacacccccacacacatacacacacataaaaatatgcacacacatacacacacatacacaacacaccacacacacacacacacacaccttgagccttccccatgcttaagagccacccagcttcttaatctgcccaccccagaaccaggaagaaagagggaaatttcaagagccttgggctccattctttgtgatgcccagatgtgttttctcaggctgggcttgtactggacgaggctgaacaggagcggggcagctacccctccgctaccactgctggcttttcctgtgcctcctgttgctcccttattagatgaccactcaaagcttaattcctctcttatgttgtttgaatctcttcagatcacccttctggccttcactacctattttcttcttcctcccactttctctcattcttttccccctagaacaccatcaacccctcagcccagccttgctcaggcccctcagaccatgccttagtgttcccggcaggccctgcttccaactggactcactgcagcctgatgatgtccttgttactttttcacacagcaaatatccatccaacaggcactcttctcttttcactcctgtctgcaccctcgatactcttcacagaacaagctctagccctctccatagcagagaacctgcctactcctctgagagatgataaatgctcccagagaggaatcagagctataggtgacagctccttattcctattaggtacagagaggttgaagggagagggctgggcatccagccttccctggtcctcctacacagctgtgcaaggagcacagcaacaagagcaacatcacagagagagaggggccgaggggaggggttgcagcagctcagcaggaaggtctgccatgtcccaccatgtctgatgcactcagttctctcaattctgattcctacactcagccctgctctcaactgtgtaggaccccaaaaactgggttctctaaagggtctgaaaacagccaatccaccacaatcaccagcaagtgctgttatagtccctctcttctcctttccaattaaatgaacactaaatggactcgaatgcgtgaagtctgagatatcatgacaagaagtaaatttagttactctgaagcaagctaggcaatgtgtgagtttatgcaaacaaacatttttatgttttattataaagtgtaacgaatgttagtcatgtgagtaaactgggtacagcacattgttctctttgtattttggctgctgacgctggtagaggaggcatctgtctgccctggattaacttctctgtggtatctgctaatgaatcagtgaggcagagaagcttcctgcaggatctcccgacctcggcacacctgtccacctgtccatctgcccacctcatgctgcagcgctggaattcacaccaatgaaccagtaaggcagagaagcttcctgcaggatctcccgacctaggcacacctgtccacctgtccatctgcccacctcatgctgcagcactggaattcacaccaatgtgcaaacagttggcatcactttgaagccactccaaggtggcatctgcacttaataacaaacaccctgcaaaaaccgctgtgcagccgtgggcctaaggtatgtgcccacttcatcagcctcattctgggccacttgtcctgtcccgcttccttcatctccccatgcctgtcaccaccctagctgttgtgcaggttcttgagtgtggtattttccctcctgctaccgggtcagggagagctcttctctgaggctggccagcccctccggtagttcactttactctcacaactgggctcccttcccatcacctcctgtttctacctaaaagcaggtccttccatcggaagctcttctaacagtgtatctttccttcctagctcttcatgcagttcataactatacactatattttggtaatgatgtcattgtctctcatgctagagtgtaaactgtctagtgatagggttatatatgctgggttttttttttaaataatgctatatctaatagtgcttggcacataggaggtactcaatacatatttaaatatttgtgacattaatgaacaaatggtattaaggatacagaccaagagagctcaagcagaaaacagaacacagccctgtcatgcagatgtccctacgtaaataagccattaacttctctagatcaagctggttgggaaaaatgacatctgtggataacaaatgatgaaaactttgttcttaaagactgttttgtacaaatgcataagaaaagactaagttttttttcctaaagcaagtagtggacatcccaacaccatccatgggagaatgagagacatctgtcacagggccccaggaacttggggaaggattcgggctggctgacaatgactcttttcttggccagtgtggctaaagagtaataccaccttcctgatgacaaagaaacagaaactaatagcagggcatactcatggttagttggacataattgtgtagaatgaattttatacagttttcattacagaatgtggggtgtagtaattctctgcaaattctttgttcattacataaaatcctgggttgaaacagccctctagatactattatgcaggggggccagaactgactacgtcttatttgacttttaaagtcaagtttctggtggacaagccaaataaacagccccacttaagagaattcaatcctaaagaagtttatttttgtctgggtgtgctacgtattatactagagccaattacaaatgtttaaaatagctaaacttttaaaaatgtgtttgatgcttttatatgcaaaagtgttttcaaaaacaataatagtgtcaataaacagagtatcggatttgacaaggtggattgttaagtggttgcaaactgttcccacaagacgctgatgagtgcatccctctggcctggagggcatggaatcaggccatcatttctagccacggtaactaaacttacttcttgtcataaatatctcagacttcaggcattcaagtctaagtccatgatttagatgaagatatttaagacatgtttatcaaacctgcagctgctacgaagctcagaggaagggataagagctcttataatcttggccatggtagttaatccagcagactctccatttcttcatctataaagtgtgacaatgatttcgattttgtagggttattgtaaagaattaatgagccaaggtatataaagtgaaccagtaaagttagttatcttcttttacacaaagaatagcagaatcaggatttgttaaaaaaaaaaaaaaaatcacaaaaactcaagttggaaaaatgggctaaagctaataattgtatcaataaaaaagggaaacccagcatgtagctttaaaaaaacaaaacaaaacaaaactctgtggaaggatctacaaaaacaacgacacatgaataaaacaagtaagttgtttaaaaaaacaccaaaacaccaaaaaaaaaaacctttgagtaatgtcaccaaatcgtgttcttccaaaatataataacgccatttgtagactcttaagacttgttatatataatcaatcagtcctactgattaaaggaaggttgcatgttttacaaccttagggcagagattcctggtggactgacgttaggaatgcgtaaacaacattgtcaccaatgtattccactgagttctattttataattacttatttaaaataatttgagttgctctcatagtaaacctgcatttaagcaacaaaattactgaatacccacagaatggggagatttgacttggtagtgttcctggcatggagttctagaagttctcagtggccacaagctcagcaggagacaactgctgtgaagccattgaagtcttcacctcaactacactagtcctagggccagagagccaaacgctgacctccccctctccccaagtcataagacaactctctttttcctttactacaaattatgaaaatagctacttgatatcaaggtcacaactaatttcattttattcaacttaatctcttgaaaaatgattggttttttaaaaagatacattttgcattgcatacctccccaaagcaggagtattgcagtactagagatggaatcaaccatgcttcagctacccctggttagtggcttcaggctatagcctagggcctggctttgggctccagagctttctggataataaggtggctccagtttccaatgttccctcatggtgcctgttggtggcctaaaattctgtgatttcttttaaaacaacaaaagtcaagctatgaagagagtgaggaatgaatctgccaggccagcattgctcttcaagataatggaataatcggaagacagaaccagactggaaaccttgggcctcgtcttaagctcttatcttgggcaaatctcttaagtcattgagacttgttgaggggctgccatcagatcacctttaaagtcttctctagttctgaaattctatcagctgccaactgccttggcacacaggcaacattggcctttatgaatctgtggacaccacttgcctctcaaaactgccagaaatgagttaaaaagcatgaatgttcaagactcacagggctggcagagaagctctacagcttctaaaaatacttcttctctttcttcattatctgattcacaggacctaatttaatggtgaaattccggaatggcgtgccgaaacctctgactgtgacatgaaagatggtcatcttgcacctgggattcagttatgaatggcttgccgtatgtgcaagcactctgtcatttgcctccagctgtttattcgtcacactggggcacaggagaggtgctaggagcaaaccaacagcaaaataaaaacattaatttatgcaaagctttctagacacaactgctgttgctgagaaacaattaccactacaaacctggtgttttaggttgaaccatatgaactggccaatttcacgtatgaactggccaatttcacaggtcaacaatggtgactgtcaacagtttcatatggttaaatacacacaaagccccccagtggctggggaaagtggtattctacaggtttttctctgagtgcaatgatggtgggaagaagatggacgacaactcaaatgcaaaccccagccacgtggaggctaaaaagttattatgtaacaaaacgacattatagaaatgccttctggaactactagaattaggtgggaattcttaaggaaaggaaaatcattatttctagagttaacaaaagctggaaggaaaatgacaaacacacaaacctatcagcttaagaaaatttctaaaatttgatgtgcctgattttgaagccaacagaagagggaacagagagatgcagagaaacaatgtcctattggatcctttgagccctggatccaaccaggcttgaggccagatatccctggactttccagttacgtaagtcagtattttttttttttttttttgagacagagtctctctctgtcgcccaggctggagtggagtggcacaatctcggctcactgcaacctccgcctcccgggttcaaggattctcctgcctcagacttccaagcagctgggaccacaggcgcccaccaccacactcgggtaatttttgtatttttagtagagacagggtttcaacatattggccaggctggtcttgaactcctgtccttgtgatctgcccatctcggcctcccaaagtgttgggattacaggcgtgaggcaccgcgcccagctgagtcagtatctttcttattaaagcacatactcatgcatacacacacaatagcactcactgccgtggtctggatgttctcccaaattaatgtgttaaaacttaattcccggccgggcgcagtggcactttgggaggccaaggcaggcggatcacgaagtcaggagatccagaccatcctggctaatgtggtgaaaccccatctctactaaaaatacgggcgcctgtagtcccagctactcgggaggctgaggcaggagaatggcatggacctgggaggcggagcttgcattgagctgagattgcaccactgcactccagcctgggtgacaaagcgagactccgtctcaaaacaaaaacaaaaacaaaaaaacttaattcccactgtagtggtagtaagagtggggcctttgggaactgattaagccatgagggctctgctcttataaatgaattagtaccttataaaagagctagagggaactaacttaggccccttttttgcccttttgcattctgccacgtgaggacacagagttcatcccctctggaggccacagcaacaaggaaccatcttgaagttggagcgagcagccctcaccaggcgctgaacctgccagtgcctggatcttggtgtctcagcctctccaactgtgctgagtaactttctgttgtttataaattacccagtctgtggtattttgttgtggcagcacaaagatacccaccacatacacaaaagcttatgatgctggaccaacccatctcaaaatgttgaactgaatcacaacaagcaagacccatttcatatcaaaacttcaaaaaagctttggcttctagtctgattcacaagtacatgcgttcaaggcccaagcagttaaaaccctgcacagataaattgtaagagcctgggtaaaagaaaatagaatttcctggtaagtgagaatgaaaaaaaaaaaaaaagtttaccacatgtgtagatttaaccagtacgttactaatgcagagaagggaagaatcaggctatttcataatcaaatgttgataatataagagaggggcaagtttattatgtcctcatcagaagcaagaagctggatgtcaggtatactgtgaaaaattgcacaagccaagacctaagactggattaaaattatcaaattgttattagatgaaagttactagaatattgtcagattatcctaaccataagagtagcagaacagtactcaatgtttctaatcagttttgtctattttctgagctggttaaacatttgctgatgtgcaatttgtaaagtcacagccatctgttcatttgtgtcttaagtcttcctgcataaattctgctcttttacctgttttggggaaataaaagtttattttaatttactgccaaaatttgtggcacaggaaagggataggttgaaaccaaaaactattttgcttttttaccatctattagtcatcctttgaaaaatcaatattcagtgctcaccccgtctgtggctccaggcaatcaaaagaaaattgtgtactgtccccattcagactgatgatgcattgtgccattatcctgtgagctaatatgagattcagtatctgctgtcttacctgacaaataagccttcagaatccaggcttgggcacattatttgaagaatctgcagctttaatataatttatattcccaagttccttctactgcttcagtatatgcagcatatgacttgagatagaaggataaagaaaccagaatgattctcttctttcctaccccatcatctgatcaattctggacattcctttcaaccctgtggccatctattacaagttgagtgcctactatgtgtcagagaatatgttagctgctgggaagacagttatgaagaagacggggtctttccagttgttcaactttttttgctactcataaagaggataaaagaaagagaaagaagagaaagaattccagtctgttaggaaatattataaaattactccaaagtggggatgcagaattaaaatataccagaagtaaaaaagagaaatgctgatgttctatttcatgatcaataataaaaacagtaacagcttatatttgttgaatgcttattttttgccatccatattgctaggatttgtcttacttaatccttatcacaacgctgtgaggtaggtactgtaaataaatccattttagaaatgggaaaactgaggctcagggaagttaaattccatgtctacaataaaatatctcaaagcaatggagttgccgcagaaacctacctgcctccgatacctgaacccttccttgctatgctatattgcaggaacttggccctaaactgacaccttgccaacttgggatacgtgttatttctaaagatgaactttcaaagtgggttaaaagagggagaaggccgggcgcggtggctcacgcctgtaatcccagcactttgggaggccgaggcgggtggatcatgaggtcaggagatggagaccatcctggctaacaaggtgaaaccccgtctctactaaaaatacaaaaaattagccgggcgcggtggcgggcgcctgtagtcccagctactcgggaggctgaggcaggagaatggcgtgaacccgggaggcggagcttgcagtgagccgagatcgcgccactgcagtccgcaatccggcctgggcgacagagcgagactccgtctcaaaaaaaaaaaaaaaaaaaaaaaaaaaaagagggagaaaaatggtaagacatatcttcctaacagttagaaatgaacagagaaatgagtcaggattgaggacagggctgaaggtgtcttctgggaccagtcaagagtggggtgtggtcaggctgctgctgctcactcctcctcccacgcagcacccacaggctgcatggtgcaactgggaggcttgctggaaaatggcaagtcctgctgcaggcgggctacagtgggcagccctcacctccactcctggccaaactgaccagggccactctccttacacagagaccatgctgctgaccaggtctctctggggccatcagcctcaggtcagcaaaaggtcttacaaaagtcaagaaattgcttatgattacagctctgcaatgcaaacgcgtttttaccaacaaagaaaaaaaaaaggttggagaggaagaagaagagagaaaaagaaacatttggccaaggccagaaagggtccaccgaagtcagcctccgaacttccggtccaatgttgacaccttgttcactggtgacaactcaggactgtaccccaaattacacaatgctacttgagggaagcaggcctggcagcagagagagaattaccggcacacattagtgagagcaatcgcagccaactcaaaaccgcactcgaaaacggccttgcattcatggactggtagttacttcctggtttctaagaaaccaaataaaattaaaactcaccattaataacaaaacaacactttacagtccccccttccctttcagagacgcatcaagtgacggcacctgatcaaagctgaattattaaaagtctatagattaatcctgtaactctcaagagcccagagtttgtaatttcccagggaaaaaaaaaaaaaacaaaaaacaaaaaaacagaagcaatctacaccgtgaaaaatttaattgcactttaattaccagttaagctgaatagcatgagatatgggtgcctttaatttttaatagtcgttatgattccaagagaattttaaagggaaataatttaatctcttgagagtattctcctcttctgccactgccaaaatcaaaatgaggacagaaaaaaatgtaaagggcgattcaaattcttccagatcataacccaggacggcccccagcaataataaactggctgttcccaggcagctgcactgcacattttcatgatatgctaatatagaaatgggtttcctgcagttgagttctggtacattaagcagataaacgcccttggctggggtgtttcttttttaaaatcagatctaaagatggcatacttgtttctttgtctctcagagcctggcaccaatatgggcatgcatacccccacctacgtaacacacatacacaaacctgggcacccatatacacatactcttccacatgctgccatgatgccccaaaacatccttttgaaaggaaaaagggaagagggtaacacaatcacacaaggctccaacaaaaatggaaatcagcaggtctgagaattcaaaaggaaataagcgtagcctccactttcactttatctgagaaccacctgactcaggaaggagctggcctcttgagagctggtgcaggagggagccgcctggaccgggtgaggctggccactttcccctttctcaagcacacactggccttctcaacttgctgaggctcttgaggtttgcctgttgtgcaggtgtagttgtctccattgaggctgcagtgtgcctcagcctcttcttggggatgctgtcccatcccaggacagtgcttttttttggaaataaattaggttgtgatttcttttttttttagtttttatttgtgagacagagtctcattttgttgcccaggctggagtgcaatggcacgatctcagctcattggaaccactacctcctgggttcaagcgattctcgtgcctcagcctcccgaacagctgagattacaggcatgcaccaccacacctggctaatgtttgtatttttagaagagatggggtttcaccatgttggccaggctggtcttggactcctgacctccgcccgcctcggcctcccaaagtgctgggattacaggcgtgagccactgctcctggccggttgtgattttaagaagtcagactgggctcaaaaggcttttcatgaggtctccaaataactcagggctctgtactgcctctggttcctgctgctcactactatcaaacacataacaagtatgggccttgttattagtgatcatttggtaaatcaattacaatttcatctgtcaggcaaataagagaagaaaaaacctgcagaaccatctgccacttttctcttctccaactgtgcacccatttcctttctccaaccctctgtatgaaacctgcactgacagacagtgctatgccaggctttcggggatttgtctgtgtctccctcagggaccaatagcacccacctcagttgggacccacagagaaagcaggagaggcgctttcttcccaagcccagtgagttcaaaaggaggaaggagtagagttctaactttgtgaaccaaagaagtgcccctccctgagaaccctgctgttgttcctttgtgtggcagctggtcatacagacaaaaacactcaggtgagagagaacaaggagtgcaacgtcaggaaggcattgtttagattcccaagtaaaggctgaaagcttggcgtggttaggaggcaagacgcagaaaacatcctagtgcgggcacaattgtgcctgaccaggacaaaaaggggacaatgaaaagaggatcctggccaggccagcacagaggagcttcccagggccacactgctcagggacaattccctagtgagacagaactgcagactggtggcagaagtttctctgtattatccttgacaacttattattgtaaagatttggaattagctgtactgagtcttcatcatagatgacaggttctctctcattgtcattttcacaaagtcccaagataaagagaccctccaggtagctgaaatgcaggtacccaatttaccactggagccaagattttggtttcagaggggacaaacgaggtaagtagtactcattgggtaccatccatttcaccaccagaaaccaatttcaccaagtttaacagttcttcctgctgcctgggcaggaggcggccttgtctctttccgcagtactctgggagtctaccacaaggcagcagagccttcgagttagagcagctctttggaacaaacatcacctctcttgctaggtgaggcctctcacccaacaggctgggagaggctgtcacagaactcagaactaagagcctacaactcattctgcagctcaagtatgagacaggctcactgtacagcaatttgtactggtgatccctcccctggggatgacccccatgactctggcgccctgaggcagggcacctgtttcagaatcccccgctaatcctccttactcccttcccagaactctaagcatccttgtacagatggcattggtactggcaagactgtggtctgtgagtagtcaggaagccagtcgacagcacctactctgttattcacccaaagcctctgtctccactgcagccacggagttgaaggctggtgggggcagggtttggggagtgattcaagaactgatcatccctctgacctgcgctatggacctgagcagcagtttcaggtgtgaggagcgtggaaaagggaaagcctcttagagcttatgtgtctagcctgggtaagccccaggaccagcatcagaattctgtaatttgaatgagaactgagctgagaactgcagagaaagacgcacttttcaaagaattccccaacagcaaattgaaatatgggcacgatgctgaaaagagatgaggctgccaaagccacgtggccgagcagacggagggagtgcagtctccacactgaggctgactgaaaacataaataactaggcaagatttttcagtagctagtgaggttatcacatactctggacaaaatccctagtgctcattacacttctgatatgattttctcacctctctccaggctcactgatgcatcttccaattcaacatggcttcttgcctctgaaaggagagctagtccctcctggaatttgtaagtgtgaaggctgtgtttcagctgtcacgtctggtgtatcactgatgcctattcctgtggcctttccagtttcccagggtgatgcaaatgaacaccgtgcagcaggtaaacagagcgctgaagtgcaaagtacagctcttatttatagatcaaacacctgccatcaatttaaacagtagttatctctaacttgaaagtttagcaagatactgaatgcccccttgaagcaaataattttgaagcagttcaggtatacagatgtgtttccagcctacttaagaatgctataattatcatcaaaaagacagattccattaactatctgttatgctttctgtatgtgtactcccagacagatttgaaatgttgaaagtcttgggtttcttagcactatacttttaacattatttttttaaaggactgggcttaggatcttctgaatttggaaaaacatctgatgagaggtttttggaacagttaatgatctaatgtggccgttcttgtcattttgcctttacaaccacagttccatttccaccctctctctaccagacacataaaaatttcatatttggaaaaagctatcttcctaaacacagatcagtgaggagtgaacacatctctaatcacaaatggccaataaccactatttcttgaaagttaaaaatcaggtgatgtgctgtacaggtgctctatggatactgttccattaatctttttgatgaattcttgaaaggttatcttcattttactgatgatataaactgaggctctgaaaggttaagcatgctgcctgaaatcacccacctagtaaatggaagaatttacatttgaacatgggtctgtgtccactccgaagcccgttcttcctactgcatacaacacactagcacagaagatggtcctctttctttgcttagattgtttcaaaattgattttccattttcagggatatggaatgtcattctggaagtaggtgataattatgttcggtggcttgagattggcatgatctccgggatacgagtctgcaggccacatcagccagtcacgtgtgtgggcaactcactttacctcggtggacctttttctctcccagaaaaccataaggatggattgaaggactaaagtccaacagttaaaactgttccttttaattctaaaatcctctgagtgtatgaactgcttcacctttgcatagaggacaagcttgtgctcaggagggcctgaattatttcagttccctgaatgtgctggccctcctcatgcaggagctgccccagggtttgtaaaccttcccctactaccaggcaccaccactgctatctgatggccgcacaaaggaatgagtgaacaccgtcaggaagacattggtcctgtgctctacgagagggtgtgcccaaccaccactgtcctctcagcatcctccattgtgaccaacgtcaccagggctgcccgaggaaaccctaagagagggaggggtattttccgtgaaaacacacctggatgcaggtctaggaaaccaacccctggtcagagtagcccaagagagaacaggcccatgcccagtgctttggtaagaatgacaaattcttacttctaaacaacagttccaaaaaaaaaaaaaaagagaaagagcgagcgagagagacagagaaactcactcagtagcaggaactgagaagaaaggggtcactcactcactcagagtgggctgggagggaaggcttcatcatttatcaggatatagtcatgaatacctctttttcttctttggaaaaatacagactactgtgggtgagtaaatctcatctagtgggcaagccggagtttgatttgagcaaagaatagaggggtagttggggtgaggaggtgaggaggagaggaaggcatggagccatggtcatgagacagcttctttttttttttttttttttttttttttgagacggagtctcgctctgttgcccaggctggagtgcagtggcgcgatctcagctcattgtaacctccgcctcccaggttcaagtgattctcctgcctcagcctcccaagtagctgggactacaggcgcccgccaccacgcccggctaatttttgtatttttaggagagacggcgtttcactatgttggccagcctggtctcgaactcctgactttgggatccacctgcctgggtctctcaaagtgctgggattacaggcatgagccaccgcaccaggcctagacagcttctttcatttgaaaatgttctcttagataaaatgtataagggtcaacatgcagcacacaagcaaacctccttcccccaggtgcaagcacagcagctggcctgaagataagagttaaatgaatccagccccctgaaaggaaggttgtctatgctacagaatcaaatcaggaagaaaggaagctattctctcacctaagggcattgagaaaggtacatgaatagtaattatctaaaaagagataatcaacaaggagtcagaagggcaaaaccctgtctaactaatctacttcacctttacagcaaggctgaagactaggtgggcaacagcgctgcatgtcaaagggtttactgtgatttcacaaagctccatagaaagcctccaaatgaagactggcaggctgggaaagtctctgaaaccatgaagaaaagggactagtggaggagctgccctcaagagaaaggcaagatgttgagtttagatggcctcagaatattaagcacctaacctgctctgtcatttaggttaattcatggagccctatatatatatatatatatatatatatatatatatatatatatacagatgaatcactggcatgagatcagctaaaatattcattgtagttgcttttaggtgattgtagatttcttcattgtttcaccttttccgtatatttttaaatgacagcaaaattttataataaagtttttataataaatttatttttataataaagaaaaataaacagaaggcaaattgatatcctcacataatgtgggagctacaaaagggatcctaagtcaaagttagtgcccttcctgtctagcctgggaggaaaacgtgactattaaattaattactgaatatgatgtgaactgcagttctgaggacaaggacctgcatttctggtctactcctgttttgaaggtaaacaatttaataatttcagtgtatagctacctccaattatccaaaccactgtcttcataggaatataagaaaattaaggtagatacctgaagcagcaccaggaatcaggacagatagagctcagttttttaaaagaagattctttcctggtcttcttcaactgggggcaaaaaaaaaataaaaacgaaaaaataaacaataaaaataaataaataaaataaaaagaatgctactgttacaccacatacttgttttaaagtcttgcccttctagtactgactacacgcggccccagggacctgtgaaatggatgctgctgcaagattttatttaaacaacatcttgatcttctgtgccatgtgactggcattgcggagaagctgctctttctaaaggcttcaaggtcacttaagcttgtgccggctctgctaagagctccgatgaggaataaactttaagatcttctactagacagaattttggaattcccagcagacctgtttcccttggcttccagatcctctcaaatgaccttatcccttatcccaccatgcacacacacacacgcacgcacacacgcacacacatgcacgcacacacacgcaagcacacacacacgcacgcacacacgcatgcacacacacacactctatcttcactgaaggctcccaagacatcttcctcacaaaacacacaaaacaaagacagctgtccattggtgctcaaaataaatgaagggtaaactaagcccacagacaccatgaggtgaggtgatatcagaaagccagagcaggacaatggtcttgatccatccgctaaatctttaggtacaacctccaaggaaaatgactttcagtcaagccaggcaactattgctaccaacaataaaacagaagatgcttttacactcatggccccagcattgtttctcacaactaaaagaggccaaacatcccaaccagaaaaaaacacaaacacacacaggaagcaactgttaacaaatggaacgtgatagtggcagagcccagaagagctgttggttaactcaacacgaaggagtccttgcctctcattcaggggtgcacacagacatgaccctaccatgcttttccttccatcccaatctccatggtcatctagtccaagctgtacgctctagtttttctcaaagtggagcttatgggtaacctccatcagaatagctggggagctaatgacacatggatcccagatcaaccaaggggattttagagacatggggcctagcccccaagtgactctgatgcatattaagacttgagcatcacaggtcaagaagtacacagatcccagttatcaacatagccagatggctggtggtagaagcaaccctgtccctgtagcacctctctgtgtcctgctcaaaagcattaaaacatcattcttagataagaacagagacaaaggatatgtctttaacactttacagtctataaagtttttccacagccactgtctcactgaatcaacccctaagagacagaaatgaaaatcgctgtttttacaaactgagaaattacgggcctttgaagtgtttcacagccttcacagcctgctggtaagaagcagagatcaggccttggacctgggtcttgtgattccaaagcccatgatccttcggattcatcaaagctccactccaagtgcctactgggactgccttgcagcactcaccttctgtaggtgagtaggtaagttgcggcatgccattctttcaaaagaacagtgcacctctgtgaccgaatatgggccacagtatctcaaggatattttggtcaaagccctggggtgtggggcagaagataatgtattcaatgaagcttctagagaaaagcataataaataaagaagctcctacctgtcgctagccttcctaaatatcccaagaaatcaagaattttctcccaatggattacagctgagcatctactcagaagagaaaatcaagtccatttcagtttagacggcagcagcaaactccccacagagagtactcccggggtggctagggggtggacagtgccattactgtatcaatcaggccaaggagtggggcttgcactactgtttgctagaatggagcttggctctaaaacaggattctcagacacatttcagaataggacgactggaacaatgcaatactcatctaagcaactgcaaaagccagctacaacccaactcaaggtgccatctattatgagaggtccccttcatctatgtaaaaaaaaaaaaaaaaaaaaaagaggagccaagatggccgaataggaacagctccagtctacagctcccagcgtgagtgacatagaagacggtgatttctgcatttccatctgaggtaccgggttcatctcactagggagtgccagacagtgggcacaggtcagtgggtgcgcgcaccgtgcgcgagccgaagcagggtaaggcaatgcctcactcgggaagcgccaggggtcagggagttccctttcctagtcaaagaaaggggtgacggacgcacctggaaaatcgggtcactcccacccgaatattgcgcttttcggaccggcctaaaaaacggcgcaccacgagattatatcccgcatctggctcggagggtcctacccgacggagtctcgctgattgccagcacagcagtctgagatcaaactgcaaggcggcagcgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaacacagcagtaacctctgcagacttaagtgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacatggcagggtattccaacagccctgcagctgagggtcctgcctgttagaaggaaaactaacaaacagaaagcacatccacaccaaaaacccatctgtacatcaccatcatcaaagaccaaaagtagataaaaccacaaagatggggaaaaaacagaacagaaaaactggaaactctaaaaagcagagcacctctcctcctccaaaggaacgcagttcctcaccagcaacggaacaaagctggacggagaatgactttgatgacctgagagaagaaggcttcagacgatcaaattactctgagctatgggaggacattcaaaccaaaggcaaagaagttgaaaactttgaaaaaaatttagaagaatgtataactagaataaccaatacagagaagtgcttaaaggagctgatggagctgaaaaccaaggctcgagaactatgtgaagaatgcagaagcctcaggagccgatgtgatcaactggaagaaagggtatcagtgatggaagatgaaatgaatgaaatgaagtgagaagggaagtttagagaaaaaagaataaaaagaaatgagcaacgcctccaagaaatatgggactatgtgaaaagaccaaatctacgtctgattggtgtacctgaaagtgatggggagaatggaaacaagttggaaagcactctgcaggatattatccaggagaacttccccaatctagcaaggcaggccaacattcagattcaggaaatacagagaacgccacaaagatactcctcgagaagagcaactccaagacacataattgtcagattcaccaaagttgaaatgaaggaaaaaatgttaagggcagccagagagaaagatcgggttaccctcaaagggaagcccatcagactaacagcggatctctcagcagaaaccctacaagccagaagagagtggggagcaatattcaacattcttaaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcgctaaacatcgaaaggaacaaccggtaccagccactgcaaaatcatgccaaaatgtaaagaccattgagactaggaagaaactgcatcaactaacgagcaaaataaccagctaacatcataatgacaggatcaaattcacacataacaatattaactttaaacgtaaatggactaaatgctccaattaaaagacacagactggcaaattggataaagagtcaagacccatcagtgtgctgtattcaggaaacccatctcacgagcagagacacacataggctcaaaataaaaggatggaggaagatctaccaagcaaatggaaaacaaaaaaaaggcaggggttgcaatcctagtctgataaaacagactttaaaccaacaaagatcaaaagagacaaagaaggccattacataatggtaaagggatgaattcaacaagaagagctaactatcctaaatatatatgcatccaatacaggagcacccagattcataaagcaagtcctgagtgacctgcaaagagacttagactcccacacattaataatgggagactttaacaccccactgtcaacatcagacagatcaacgagacagaaagtcaacaaggatacccaggaattgaactcagctctgcaccaagcggacctaatagacatctacagaactctccaccccaaatcaacagaatatacatttttttcagcaccacaccacacctattccaaaattgatcacatagttggaagtaaagctctcctcagcaaatgtaaaagaacagaaattataacaaactatctctcagaccacagtgcaatcaaactagaactcaggattaagaatctcactcaaaaccactcaactacatggaaactgaacaacctgctcctgaatgactactggatacataacgaaatgaaggcagaaataaagatgttctttgaaaccaacaagaacaaagacacaacataccagaatctctgggacgcattcaaagcagtgtgtagagggaaatttatagcactaaatgcccacaagagaaagcaggaaagatctaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagacgcaataaaaaatgataaaggggatatcaccaccgatcccacagaaatacaaactaccatcagagaatactacaaacacctctatgcaaataaactagaaaatctagaagaaatggataaattcctcgacacatacactctcccaagactaaaccaggaagaagttgaatctctgaatagaccaataacaggatctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagcctggcagagacacaaccaaaaaagagaattttagaccaatatccttgatgaacattgatgcaaaaatcctcaataaaatactggcaaaacaaatccagcagcacatcaaaaagcttatccaccatgatcaagtgggtttcatccctgggatgcaaggctggttcaatatacgcaaatcaataaatgtaatccagcatataaacagagccaaagacaaaaaccaaatgactatctcaatagatgcagaaaaggcctttgacaaaattcaacaacccttcatgctaaaaactctcaataaattaggtattgatgggatgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagacaagtcaaattgtccctgtttgcagacgacatgattgtatatctagaaaaccccatcgtctgagcccaaaatctccttaagctgataagcaacttcagcaaagtctcagggtacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggatctcttcaaggagaactacaaaccactgctcaatgaaataaaagaggatacaaacaaatggaagaacattccatgctcatgggtaggaagaatcaatatcgtgaaaatggccatactgcccaaggtaatttacagattcaatgccatccccatgaagctaccaatgcctttcttcacagaattggaaaaaaactactttaaagttcatatggaaccaaaaaagagcctgcatctccaagtcaatcctaagccaaaagaacaaagctggaggcatcatgctacctgacttcaaactatactacaaggctacagtaaccaaaacagcatggtactggtaccaaaacagagatatagatcaatggaacagaacagagtcctcagaaataacgccacatatctacaactatctgatctttgacaaacctgacaaaagaagcaatggggaaaggattccctatttaataaatggtgctgcgaaaactggctagccatatgtagaaagctgaaactggatccctttcttacaccttatagaaaaatcaattcaagattgattaaagacttaaatgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaatgaactcaaacaaatttacaagaaaaaaacaaacaacaccatcaaaaagtgggcaaaggacatgaacagacacttctcaaaagaagacatttatgcagccaaaagacacatgaaaacatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcaattcctcagggatctcgaactagaaataccatttgacccagtcatgccattactgggtatatacccaaaggattataaatcatgctgctataaagacacatgcacacgtatgtttattgcggcattattcacaatagcaaagacttggaaccaacccaaatgtccaacaatgatagatcggattaagaaaatgtggcacatatacaccatggaatactatgcagccatacaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaacatcacactctggggactgttgtggggtagggggaggggggagggatagcactgggagatatacctaatgctagatgacgagttagtgggtgcagcacaccagcatggcacatgtatacatatgtaactaacctgcacaatgtgcacatgtaccctaaaacttaaagtataataataaaagaaaaaaaaaaaaagccaccgccagcatgcctctagttgctgcctcagtctgaggagctcggctgttttactgctgacaccatcttatggtatcctttgcacgatgctaacttcctccgctgagggtgaagcctcacttaccattctctgcagcaatcccaccaacctctcatccagtgactctagtggggccctttcactgggcccactttgtacttggctctccatagttcctcttaactccgtgatcaaaagacatttttacatgtgttataagcctcttttaaaaaaatcttcctaggaaagactctcttcaaatctctactagaacagggctgcatccaagtgagtccttaataaatagaatttgatcatggtaagaagacatgtcccctgctcgtgttcttgtcagtcctgaatgggtgaggcaaagtgctcagacactgtgctagcaaagggattttcagtctctgcctccctaattatgacattctttttctgcctcccacaggcacaagggccctgacgagggagtgctcagttctttggtgtgaaatatagtaagatagaggccattggcttcagaggaatagagctggataaaaaagtacaaaaggaatgtgaccagtaacaggaatggcatttagaggacctgattcatctcttctacattgttcaggacgattgcaaaatccatttctccttctctgtccctgcttctctgcccttcccccaagctttcttgctctctgccacacgtgcgtgtgcacacacacacgcgcgctcgtgcttgctcgctctcgctctctctctctcttttctaaggctccaggcatccgtccctggagaagtgcaccttgggaaggcgatgaaatgaaagaagggcacatcctcctttaaccccaaacatctgaagtcagcgccgcgcactactgcgatttcctgggccaaatgcattgttcaggcaaagctcccattcatgtcaacagtctcagcaggatttaccaaattcagccatatggacaatattcacagatactcattcaagaagctctcacagttccaacttccaccttgttgactctctctcatctgtttttcccacaagtcgttcaattcagttgttgggcaaccgttcagggaagcctttaagtagagatttctgctctctcattgggcagaagagaggacaggcaaaacagtgagaccgccaaatgaggaaagaaaattggaagcacttctctgatttagtaccaaacttgctccaggataaaactgcactataccaaaaactctggcagggtatcaggtactatggggtgggcaaagttcccaggttttacttccagagctgactgcaccagggagacccacgtgctcccgaaggcaccgcacgcagggcagggcatggccagaatgacagcagatgtcagctctggactcttaaggacccaaaggtccagggtcacattttttgttacataccagcttcctcccctactcacgactggagagttgtggcttctgcccccttcagtcacagctacttggggtgtctgaaagcatcagggccatgccatctagcaatcttccccaaagtagggaaacagcggtaccctgcacaagcttggcatagaggtgttccctcaaaattatctttgcacacagttggaggatgaccaaaatataggttgccatttaggcaaatgacacgaaggaagagatgctttgtagctaagtatcttttccatactgggcacccactaaaggttagctgtatacatgaatggatcgatgattggatgaaacgacacatgaaaggaaggcattgttttctcaaccaagccaagtactaagtaatctttgaaaatgaaaactcaggccgggcgcagtggctcacgcctgtaatcccagcactttgggaggccaaggcgggtggatcacttgaggtcaggagttcgagaccagcctggccaacatggtgaaacccccaactctactaaaaatataaaaattagcagccaggcacgttggctcacgcctgtaatcccagcactttgggacgtcaaggcaggcggatcacctgaggttgggagttggagaccagcctgatcaacatggagaaaccctgtttctactaaaaatacaaaaattagccaggtgtggtggtgcatgcctgtagtcccagctacttgggcggctgaggcgggagaattgcttgaacccaggagatggaggttgcagtgggccgagatcgcaccattgcactccagcctgggcaacaagaacgaaactccgtctcaaaaaaaaaaaaacaaaaaaaaaaattagtcgggtgtggcggcgtgtacctgcaatcccagctactcaggaggctgaagcaggaaaattgcttgaacccgagaggcagaggttgcagtcagccgagatcgtgccactgcactccagcctgggcaacagaacaagactctgtctcaaaagaaaaaaaccaaaacaaaacaggaaaatgtaaactcgccaagagctcagcaggaatggacgtgttactctcagagtagaccccataacagccacccagacacgtgagaatgcagctttgccttaagacagacattaaaggaagaaattccaccacctctccctgtaatctttgccagcgtgtgtcagccatcactcttgggaagctttttccatctccctacgttctcttagatttggaaacccacaacggctcccaacaagctcctctagatggctccacaccttcggcttgtggtttaagtccctcttcagttgttcctgagtctcatatctagaggaaactactacgggggaagttactgggatgagattggcaagcggcccctccacctgggatgagattgacaggcggcccctctatctggcctgcttctctgtcttcaggctggaaaggggctcactaggtgggcggagggcttctgtgtcttcaggctggaaggggctcactaggcgggccgaggccatgcgtggccctccctgggcatcttgtccccctctctgttcagcttttaaaaatgcctttgtgggctttgttgtgggtagggctttctcctacctgttccatgagtctggaagcccctgtgagagaggaattgatgagcacagcaagaaacagaacttcactgagcatgctgaacatgtgtcattattctaaatacatttttctttaattcctatgacaatctgtgagacagatactaattattcctattttacatctacagaaatctaaagtttagaagaattaagtaacttgcccaaggtcactgcctgagtaatgacgtatctgggtctagaattgaagtcactctacgaaaactccacgtcattttctcctaaacgaccttcctatgaaggcaaagacctcctctgccttaatcatctatctctgctcctacatctagtacctagcatctgctttctatgttgtatttaattaaatatttgttaaataaaaatggaagaatatgcatcatgtatttgtgccactaggttttaaggtgtacagttcagtactattaagtatattcacactgttgtataacagtcatccagaactttttcatcttgcaaaactgaaactctatacccattgaacaattccccatttctcctccctccagtctctggcaaccacctttttacgttgaatttgcctgctttagatacttcatataactggaatcaaatagtgtttatctttttgtggctgacttcacttagcgtagtgtctgcaagcttcatccatgttgtagcatgtgacaggatttccttgtttttgttttgttttggtttttaaatagagaaggggtctcactatgttgcccaggctggtctcaaactcctgggctcaagcgatcctcctgcctcagcctcccaaagtgctaggattacagccatgagccgctgcatccagccaaaatttccttgtttattaaggctggaaacactacattttatttcccacgccaagtttcttaaatgacccatttcatcaagttgcttccttaaaactctctccttatattagttcgttttcacactgctatgaagaactgcctgagactgtgtaatttataagggaaaggggtttaattgactcacagttccgcatggctggggaggcctcaggaaacttaagatcacggcaaaggtgaaggcgaagtggaagcaaggcagcttcctcacagggcggcaggaaggagaatgaatgcaggaggaactaccaaacgcttacaaaaccatcagatctcaagagaactcactcactatcatgagaagagcatggagcaaactgcccccatgatccaactaccaccacccagtctcttccttgacacatggggattatggggattataattcaagatgagatttgggtggggacacaaaacctaaccatatcactcctttaattcagcttcactctcggaagagctttaatacaatgacagccaccgctgctacctgttgagcactcacactgcgctaacggagcctctcacacgttttcacagaaacttcagggttatgactgtgatctgtagatgagaaagttgaggcccagggagattaaacggcacgttcaaggccacactgcttccaagtgcagcaatctggacctctgaccttccccagctccctctgactctacagcctgttgtcagtcactaatctttactgccttccagtgagccttagagatgatcaacacaacagagagcgacactgaggcccagatacatgaggtgacacctgtggctgcgctgcccattagctacagagctggggtgatgcctcgaactcacgatgcctggcccagggctctctgctccattccacttgcctccggcccacgtgacctctcccccaatccacatcccatggtttcctcaagatgcagctcaaggctcacttcttccagacagtaaaatcctcccacacgcactcccggtatttcgcttctcctttgctctgctggctgaattcggttggacacacactctcatagcagcatcatgtcctactctatgatcttccaaggaggaaagtgtgttccccttcccatcccaccacctaagagtgtcctggaatttggcagggcacttgatgaatgctttttgactggctatgccataaatttatgcaatctaagagctgggtgggccctgccttatcacacttattttccaggtgagaaactgagacccagagatgtgaggtcactcatgtggttacagagctaattaatgaggagccgagtccagaacccagtcttctgtcttctaatctgtcctctcctgctgctgagcccatctaaccaggattctttatcattttgcagcacagagttgtgccctaaagcctgaagtgggcagacacgaggaaagaaaggttaaattctacatttagtcattttaaggagatatgaaagtactacctttttatttccatagggaaaaaaagatgaaaaggaatactgaacagaaagaaaggaataaaaagcaatgcaaattcctagtctttatccacatattaaataaagacactctgtccttctccctctgtcccctcccacctcaatattgcttgctccttaagacgggccagggaaaatgcaattctctccagagtaaagtgtgaaagactagagaggtgcattaacattttataacctcaaaattcttcaataaattaacattattaaaggatatctggttcttcagtaccttgaaaatgaaatgacaccttctagaaaatatagattcacctcatttgcaggtttgctgtattgttagagccatctacatgtccctttccaataaaaagaaaggaagtcatacacctctgaagcattttatagttaatgaaacacttgaacacattatttttttttgatgataggtcattatgtgcttattttttgacattttaaaagttttattgtatgtttaatagacaaataataattgtacaaatttatagggcatggtgtaatgtttgggtacatgtacacatttttatcccagtaagatgtaaatctttggagaaaacctgatgcagatagaagaggcttctgatacatattaggacatggatgtcagtttttctgatttttttttttttgagacagggtctcatgtcgcccaggctggagtgcagtggcatgatctcgggctcactgcaacctccgcttcccgggttcaagcatttcttgtgcctcagcctcccaagtaactgggattacaggcatgagcccccacgcccagctaatctttgtatttttagtagagatggggtttcgccatgttggccaggctggtctcgaactcctgaccccaggtgatctgcctgactcggcctcccaaagtgctggggttagaggcatgagccaccacgcccggccagtttttctgattctacttactaactcacacttacccaagagttgtcctcttcaccttcttagcctggcttttttttttttttttctgtactgccctccagaaggaagacaatcacttttttttttttaagataggtcaacagattttaatgtgagatagtatgaaaagttcacttatatggtttcagaacaccttataactaacctataagaagctaacttaattctagggattaaataatggaagtattgaatatttaatcaatcaacaagtatttattgggagcctattgtacactgggcactattctaggccctagggatataagattaaacacagcagggggagtttccattctcctgaggttccacactagggccctttcacggatgagacaacaggcaaattcaaattgaaaccacagtgagatactaccgcccatccactaaaatggctaaaatcaagaagacatgtaataacaagtggtagcaaagatatggagaggtactctccgtattactctcatatattactggtgggaatgtaaaattatgcacccactttggaaagcagtttggcagttcctcaaaatattaattgcatacttaccatatgatctggtaattccactctagatatacacttgaaaaaaattaaaatatatttctatataaaaacttgtgcacacatgttcacagcattattcttaatagctaaaaagtagaaagagcccaaatgtccatcacttgatagataaatatgcaacattcataaaatattacttggcaaaaaaagaaaatactgatacatgccacaacatgcatgaaccttgaaactatgctaagtgaaataagtcagccacaaaaaagcaaatattttataattccatttatataaactgtctagaataggcaaatctagataaatagcagattaatggttatctagggactggggggctggggagatggggtatgactaatgagtatggggtttctttgggggtgataaaaatgttctaaaattgattgtggtgatgattgcagaactctgtaaatatgctaaaagccactgagtagtacactttaaatgagtaattatatgttatatgaattacatgtcaaaaaagattgtacataacatagtatgaagatatactgagaactagtggaagatgatctcagcagtttgttctcatgctgctaataaagacatacctgagactgggtaatttttaaaggaaagaagtttaatggactcagttccacatggctggggaggcctcacaatcatggcggaaggcaaaggagaagcaaaggcacgtcctacatggcggcaggcaagggagcttgttgaggtgaactcccacttataaaaccattagatcttgtgaaacttattcacttccaggagaacagtatgggggaaactgcctccatgattcaattatctccacctggccctgcccttgacatgtggggattattataattcaaggtgagatttgggtggggacacaaccaaaccttatcagtgtgtgggtaggcaactggcctgggcaccatgttgctgtttttcttctgtaactctatagagaatacccctctggggaagtttctgggccaaaaattggtgacagatagtaatcaacagatattgctcagactactgtaggaagtagaaagcttagcgataacagattttcctggcaacacccacccactaataagatttacagtttgctagagtggcaccagctgtatgaagattcactaaaatctcacttgagataggcaacacctatctctaaaccagaagagacaggtatttctttcttcttcctctcctcatgtcacctcctaacctccacagtgcccatgttgagttttagaattggcatttagagcaagacatagattcttggtgggtggcctcttgccagctggtcctgcccccctcctcgctacagatcacaagtgttggcctggtttctctcaccacaaacagcagtatcaacaacctcatccaaacttcacgtacctctttaccaaactagagctaatcccaagtaaacagcatttggacttcagaaatccggttccacgtttgtgtgaatgacagattccccaatattttagcagggcctcaccctcagttattcttttccatgatgacagttctgtatcttactgagactaataaattactgtccttcacaacagaggtacacaaaaggcctcaaacgatgagctggctaaaatgtagctgctctgttaacaatgatggaatgctagccatgacatatgcatagcaagcaatttttcctcatcttcaccaatgggaaggagctagcatttggccaagacctttgataagtgccatgggtcctctcacaccctcagacatgaatatttcggggtaaaccaggtacctgggtaactttctcatgtgctattctgccacagcaggggcaactgcccttacagtcttgtcccagaagaaccactaacaacttgaagtttccatcagtgagaaacgcacctgccacacagaccactttctagcatcactcacacaaaggttgtcgatgtttggaccaagttcgccagagtattttttcatttggttgaagttgttttcaatgttttccagtgactggaggtcaagtctggagcagtggcttgtattaatagatcctttgtgagggcagccgctgaaacgacacttcaactcatcactgacaagggaacagaaaacacggccaagtcaggttttgtggccacccctcaaactggccctgaaaatggcactgattctggagatggccaaatgatttaagtgtgcatgcacgtgtgtgagggataatcttggttcctaatttgggcgttttgaattggaaactttgccggacattgcctaaatcaacggtcaaagagtacagtttgttttttctctgagtaacagatatcagtttcctaaagctcactgcctttcttggaggagggaggggaggcctttgccaactttgtctacctccacgctttttgggcttactttctaatgaatgggcaggtctggggcatcttttaccacattcagtccagaaaggatctgtctgtctcatctaacctaaagcctggctcaataatgcctggtcaagaggctgggtctcacccttcggggctcgtttatataatgagtgtctctgggttcagatcttctcaataaaagatgtctgcctagcacaatccttctgaaatttaatggctgcaaccctgacagccttcaggctgggaatttatccgacatcaaatgaacaggcagcaaacaggatggagcaatctttcccaaagtgtgttccatggaactccagggttccatgggcagttaagtttgggacaatgcattccacccctgtcttatttctaagattctaagacatcatcagttttaagctcctcatcgatttaatgttttttttgtttttttttttttgagagttgaggagaagacgacacctgattataagtaatatagttttgtttttaacacacagtaagagcctacatttatctagatgagcactcaggatttcttctttagtatctcagttacagtttgcatctaatcactctttgccatctgagtctaagggttcactgagtcacttttgaccattagaagttatatggaatcttagagggacaagttgcttttcataaacttatgatcttggtctcctttgtatccttagaataaacaacataatgttgaatcctgtaaagaaatattcaagtttcatgtgcctttttttataagcttattgtttcatattttccttaattgaataacgtgactgaaaggtattgactttgctaagtgtcagctggaagctcttgacagattcttggagatggagtgatagttcttcataatgggggaatcagcattccaagaactgtcaaaccaccttctccgcacagtgaagcttccacgatccattcctagacatttggcaatctctgttgcctttaattactgcccggaatatgtgacaaaaaaaaaaaaaaaacctgcttttataatgctgattcataacaatgtttttaaaatacacattttggaataattttagatttacagaaaagttgcaaagatagtagagtgttcctatacaccctttacccagtcctctgttgctaacatcttacattaccaaggaacatttgtcaaaactaagaagcaaatgttggtatgtgactattaactaaaccccaggctttacttagatttcacccgtgcatctacccacgtctcttttatgttctgttctgacaacaatgcattcagttgtcatgttgcctcagtctcctctgctctgtggcagtttctcaatcttttcttgacagtcttgaagcgtcctggccaaatgtactgtacaatgtactctgatctgtgtttctctcttgcttttctcaagactaaatggaggtatttttgtaaaaaatgccacagaagtaaagtacccttctcattacatcctatcacaggggacgtggcagccacatggcctcacttgtgaagctaacctgatcccttagttaaggtagtgtttgccaagtttttccactgcaaggtgtagcaaatgaagggatctaagttaaattcaactttggtggactccctattttaagaactcacctgaggtgccatcaaatgggcaagcatgtacaaagactggctaggtccctgcatcttgtgcaggcagggacaacctcagcgtcctggccagggccgggagctcattggcgtgagaagccagacacactcactctcagggtctcacccgcatgaatcttgcaccccatgcacctcatttaacttgctctatgcccatccccgcttctgacactgattccaaagtttactctaattttagaaacattgaagtataaaaacatgggctttttattttagaatcaagtgtactgtaaaggttctgggacatcctgcagtaaccttatttaacctacagtttcccaaactaatttgatcacagagtcctcttttcacttaaggccctttcttcacctgaacctatgaatagaggggaaggaacagggctgagccagctgaatctgctttgagtcccagctgcctgactgtggcaagcttcctcataaaggaatgctcttcagagcctctgacatcctcagtcacaattctgatgcatttaaatgcatttctttgacctctcatacacccctgggaaggctctgcttgcacgtctgtgagctatgcacggatatactgacagtcctatggaagtggctgacctttgtcacgatatccgggagtaaaaatggtccagacaggcaggtaagcatgcgaacactgagttccaaaatcgtatcagagctgcctgctcattggaccactgtgaatgaggatgggctcaccccagccccctactaacctttgcatcctttaactgccaggactcatacctgactctaatagaatgaacttctgttctctgatactacatcttaacgtcctctgaggaacactgtagtggcaggtgggtaagctgaaaatttaggaagcaaattataatagacatcctagccaacctcatttcacagttctgagcagccccagtggagcaatcttcctgttcggaggatcacggcaacacagggagtaatcaccatttcagcccgtacatgggaggccagaaagggagatcctagtgtcatttaggcccaggctctgccttggctattgacaaggtcttttagggtatggggttacatttttgtcccactaaatgacagcagcatttggtgggtaacatgcatacataagcgcatagggccatccatcaaatcaacaattcatatagtgagtctcttggggaagacattcccacgttataggaacatgggccttttccattatatgagaaagtgaacttacagatacataagggcaactattcctttcatttttaaaaatttgtcaccttttaccaaaagaagagtggcacggtagaaaatgcatgagacttggagttggatatgcttgggctcaaatcctagttcctggggcaggtttccttttttttttttttttgagagggagtcttgctctgtcaccaggctagagtgcaacagcgcaatcttggctcactgcaacctctgcctcccaggttcaagtgattctcctgcctcagcctcctgagtagctgggaccacagacttgcgccaccacacccagctaatttttgtatttttagtagagacggagtttcaccatgttggccaagatggtctcgatctcttgacctcgtgatctgcccacctcagcctcccaaagtgctgggattacaggcgtgagccaccgtgcccggcccctgaggcaggtttcttaatttctctgagcttcagttttctcatgggtaaaatggggataaaaatacatacttgacaaggatattatagagctcaaatgagacaatctgctgaaatatttttagcctggcacagagaaaattagtaacaaacatggaattccctttcactccaagctccctttacactagggactgtctcatggttgataccagatggcccggtctcgattctgcacaagcttggtactctaacaccccagttttaggaaggcctcaagaacaatctgcaggggcaggggacctttctaatgatcccacacactctctggactgtatgggatcattaggaaaaacaggtatcagcgccctgatgcaagtccttctgaacaatccagggtttagcaggaggccaaggtgtttgatcctctctggacattatcatggctggtcttccttctgttctccgtcgacgtgacttgttagcgttaacagtgcctgtgggcaggaattaagaggacagcgaaaacttgctttgctagttaatgctctctctgctctcagagagggtcgagagacaacaaaggctcattcctgccagaaccaagaacccccacctcaactcccaactcctaccaaacattagccacccatctgaccctcatagacgtctccaagatcgaaaaatatcctttggcaaaaacgaatcattggcaatttggttattttaactacttctgtggccaggagagaaggatgagagtttcagctggatataaacagaagcaggagcttgaagaggatgagagaaaatgaagccagtgctatgatacagtccaagacagcctggtttcagttgagctgaggagaaactgaagctgatttcaaacgagtctgaaaacccgcatccctgtgctcccctcgcatagccactggccttcccatcctccgtgcggtcctgaactgaccatgcactcacaatagcacattcagggctggccatagggagccgtcttcgtgcaaggcaagttcttgagagaggagtctgtgtttatgaaggttaattccaggctcagccaaaggccacctaaggcacaaatgctccgagtcggttggggtttgtgtgttccatccgctgctgggcacctctctaggatgcgtatttctagtcagtggaccgtcctaaacatgtgaagctgctgacagatgaaagctggccttgcttgtggcatccattcttcagggcttgtacctgctcttataaggaagtagaactcagagagcactcactggcagcaggggactggtcctacactcacagcaatgtcccgactcggtttcagtgatggcttcaatgtctcattttgtgtcaccagtgttgatgaaaccttgacaaggcaaagcaaaacgacaagcacgccctgagcagagccccgggaattcaacctttaagtggataacttggcttctggtttgccaaggaaccagggcatcaaacagatgaaacagcctattgtccatttcaacaggatttttcaggagtggggatgatctttcaaattatccacaacttaattatttaatattttgatagtcaattacctaagacacggcatcgtcactgaccaatcagaagagatgccagtagttgggcgcagtggcagcactttgggaggctgagtggacagatcacctgaggtcaggagttcgagaccagcctggcctacatggtgaaaccccatctctactaaaaatacaaaaatgagccaggcatggtgggcacctgtaatcccagctacttgacagagtgagcctctgtctcaaaaaaaaaaaaaagaagaagaagaagaaggagaggaagaagatgaagaagagatggcagccacagctgggagacgggtcctagaaatcccccgtagtgcagggcatcctccctgtttgcttcttggattctgggaaagtcctcggtggcaagcctgagaggctgggcaaaggggctagagcagtggctattgacctccagggaagaggcattctatggcctgaacaagcagcaggcagcaccaggtctgggtgattctctgtcctgcagtcgtgggagatgagggcacgtacacgagggaagaagcacagaaaagaagcctctgcaaccttcgcattttttatcacactgtgttagtacccaggagactttagccttcccaaatctcactggatcaataacttcaggaaaaagaatttccaggagccaatttccacattagtttaggtgccgggaggtctttggaaactcagcccgagacacccggagacttctagtccacccccggggaattcagttcaatcctctgaaacactcagactatctcctctaggcaccgccagctcaggtttctactcagaacacatacatttgtgtctggggaaaggcaaggcatgaaatatacttcactgaaaggttgaaaagcatggagggtaaagttaattttcaaagaagaaaggaagtcaacggcataacacaatggaatgtgtgattcacctctgcagggcagacattgattttcccaccagggagtatcatcgaattagttggcagttgaaaatatgatctctgacttttttttccattccccttaggtcctacattttattttaaggccatgaaacaacatgagattaaaagtgtcatccagaaacagaagtggaaaagatgcagtatttcttttgttcaaagaaaatatttttgaagttatttcacaactaaaattgcaatgacaggtgtgtgggtggggtgcatgggctctcctcgcttggttcatattggacagaggggaagcctgtgggcttagggggcacagacccctcccatgaagagtcagcatcagggctgctctgggtgtaacccaggtcctgcaccgtttccagtggctggtgtcctgggaataggcatcagttggaagccacaccttcaccctgcgggggatgaggagggctaatggtgggagaaatcattcaggtaagaaatgttctcccacctcctagatgtgtggctttgggtgaggtgctcaactctctgagccacagctttcagagctctaaatggggactcataatttctgctatatctagatacatgtaggtctaggtttaggtgttctgatgcctaacattttgtataccttctttaagaatgccaagttgacaaatgcagaaatgggaacagagttttcaaaggggctcctgcaagtggaaggccctacagtttaagtctcgttagtgtcatggtgaatctaactttgcacacctgcctatctcaaataagaggtacgtatataaatgtacatctcaaactataattatataaatacatgatgttgaattactctataaatctgtaatacttaatgtatgctatgtgaggtgcaggaaataaagctgtgcaggagacatacaatcccacccgtatgaaacctaaaatctagaggcgttgcattatcatctatgggaggacatctattcagaatgtcctctgaatcctgaacttggaagtgaggcagatcacagtggaatggcttgattgctcgtctgcagcactagcccctctcagggctctctgaggtcctgatgccacacctggctttctgggcggtgagctctgcttgacctctgtctctgccctctccttgccaatcactgccttctcactcactctcattttgaaaccctcacagcaccaggccagcctttttattttattttaatttttattattttgagacattctcgctctttcgcccaggccggactgcagtggtgctatctcagctcactgcaagctccgcctcccgggttcacgccattctcctgcctcagcctcccacgtagctgggactacaggtgcctgccacagcgcccagctaagtttttgtatttttagtagagacggggtttcaccgtgttagccaggatggtctcgatctcctgacctcgtgatccgcccacctcggcctcccaaagtgctgggattacaggcatgagccactgtgcccagcccaggccagcctttctaacctttattttcaaacaggaatggatagcggtttcctggggaggcgggggcgacagtaagagaatgagggggtgacagccaaggagcatagttttctgggggagggtaattaaaatgttccgaaattgattgtgatgatggatacgcaactatgtgactacagtaaaacccagtgatttgtgtactttcagtgggtcagttatgtggtatatgaatgatagctcaataaagttgttaaaaatatgaacggacaaccaagaagcatctaaaattcaagaaaagcttggagcaagagaaagcagaattaataagcagggggaaaaatgaagaacactcagttcattcagaaaaaaaaaacaattttttaaatgaccaattatcctttgagagactcaagaagatgctgcatccacaaaataagaatagggagccatgaaaaaggaactatccaaaaacaagaaagagttcttgtgaattattaaaacaataagtttcctaagagataaaattttgattaaatgtctgcacaatgaagtcagggataatccctagagcataaagcaaaaggcccagacactagaaaaagagaagtttaacatgtgataaccagcactttcagagtgaaagaacagaaaaacagaggaaataaaattaaaaaggaaaaaatagggaaaacttttcccagagctaaaggaagacaagaatgtttaaaataaaagggtcttgtaggaatgaaaaagatacccatgccgaatacatcagtgtgaactttcagaacatcaaagagcagagcagagcctaaaaccttacagaaaagataaaacgggtgattgacaaaggatccagaagccaagaagcatcagaaataacagatcttacgagaccgtgtaataggcttttgaaattttcattgaaaattattttgaatggagaattttatattctaattctccaccaagaacaagagtactaaatctcaatctaatagtgggaaatcaagagatactgcctgaagttgatggaacaagaaatagaaatttcaatatagtgtttgaggtgtcacaggttgccaataaaagaattaaagtactattaccttcatggaaaaagagatgtagaatagagaaaagaacataataaaagctagatctttatttttcatacctaggaatggaccacttcttcagttgtaagaaacttaaatctaaaaatactacatagaggtaataaatataactctgagaagtattgaaaacagacatggttaaaaaaaaaaaacaaagttgcagctaaggagcaggtctgaaaggaaaagggagggatcccagggggagaagaaacccactgctttttattttaaaaatgagatataaggccaaactttttttttcaactaattaacgggacttttaaatacagatcctagaagcagtgcagagagccaaggcttggcatttgggtagctgcgcacttccaaactatactgcatgaaagcatttcacagaccgtgagttgtccagttacttaactttgggagatactgtcattcttgatgtcccttttacagattcaaaacatacattaagttattaaaagctctgagaagttctgtagaatataaaccattttgacttcatttaaatacaggtcaatttgctgaaagaccaatttgatgaactgttaatttgccgatgttactaaatttaccaacttttttaaaataaagatttaatactcacaatgggattgttttcaaagttttgataggaatgtgcaagttgcaaaagaaaattaaatagccaaaaagtgagtagagcacacattaatataaacagagaagattttacaaatgagatttttagactacttctggtttcttttggacatttctggatatcatttttaactttgcttaaaattttaagcattctaaggtttactttccctcatttcctccatgacctactggcctttattgtgtatttctaacaattaaacatttaagttaaatgtaaattcaaatgcatctcaaggacatcagaattttaaattaacttagatctaattcaaattctaaacggacggaaacacaaaattaaggttaaactatttacaaattggtgaaagaacattaaaaattctttacaaaataaaataacatttttaaagcatataaaaaaataaaatgtagttgaaacaatcctgtcacatatgaaatgccaaaacttcaggtagaaaaattgtatttcatataggaattgttcaaatgatgccgaattctgttgtcagccttccagcattttagaattttcttttctactgatacctcagacaggaaacatcttaatattagttaatacagtcatgtgccacataacatttcagtcaatggactgcatatgtgataatagttgttccacaagattatactggagctgccctatgcacctatataattttaaattttatgacatatttttgccctattttttctatgtttacatacacaaatacctgccactgtgttacaactggctacagcattcagtacaataatgtcctgtacaggtttgtagccaaggagcaccatatagtctagttgtgtagtaggatttcacaatctaggtttgtgtaaatacatttcatgacgattgcgtgacaacaaaatcatctaatgacgcatttctccgaacgtatccccattattaaacaatgcatgactatattcagaaaagcatctttcattgtcagcaaaacaggatcaaacacttagtagacagggctactaaatcgtcatgggtaaatgtgcatatctgaaaactaggctcttcgtggacttggtgtacagtgaactggcttttgatgaattggctttccataattgattttcggccaactgacctgaagccattttacttaacctagcttttcccaaattcatttgaccaggattctcttttcatttcaagtcaatggaacaattatcctgacagaacacactctggaaaccactactcaacaggaaggaagtcatatgcttgtactacaggccctggggaacagcaagccgactttgataataataattagcaactgctaacaggggaattaatgagaaaagaaacttaacttatatccagatgccatacttctataaatcggcagactatatattctattcactcatctccactggtgaaaagttccacgttttatattaatttttattttacttttttttagagatggggtcttgttctgttgcccaggctggagtgcagtggtacaatcaaagctaactgttacctcgaactcctggggtcaaaagtgatcattccacctcagcctcccgatgagctgggactaaaggtgcaccctaccatgcccagctaattttctaattttttgtaagacaaggtcttcctatgttaccccaggttgatctcaaacttcttgcctcgagggatcctcccactttggcctcccaaagcactgagattacaggtgtgagccaccacacccagcttatatgtatttttttaaaataaaaacattttaatagaaaattcatgggtgggaatgaagtgtttgtgttttttctctctcatgttctttgggtctgagaaagccttacacagcatgcttccatgtcttaatactctcccactcatgatggctgctgtgggaactgccagcagtgagggctggtagggaagaaagcaacacaggccagggatcacacacttacgagcccactggggtagacaggatgtggacgagtaaagccagcctggtggggaactagtggagactttggcaaactgacagagaatacgccaggtttaagaaggcagctgctacccagcatagctacagctgctttggggatgtggatccactgtaccagtcttctgattccccaggcaaaactagaaatctaagttaaaaaaataaaataaaatctcctgctttttagaagttagcaaatatttcattaaaatatccaccatgtggctaatcagaaatgtttcatatacatgaatgtgtatatatatatgtgtgtgtgtgtgtgtgtgtgtgtgtgtgtgtgtgtgtatgtgcatatacatatatgtgaaacaaagtaacatcagttgtattaccttaaaccaccaagttacacaaaaaattataagcaaccaaagctatactaactcctcaggatgttgtcttggaaccagtcggaggaaggaaagggtatgtgtggtcctaaccttatggaccacatgataactcatgacaagagaggcagtgagaattggagctgagttagtttgttttgtactttatttgtggctgagactaaagaagttttggaggattttgaaactcagaatctgaaagctagaagggacattacagtcatgtgggcaacctcctattcaataaaggaattatttgggtacaattccaacaggttgtcaactagttgttatgtaaacacttccaacgatggagtgttggatgctccattattgggtacctgaggtgttacaaactgttcttcctaatttgctggcatgaaatgtgtctttcctcaattccaagtaacaagtcctagttcctcctcctctggccaggaggaaaactcttcttccttcctacaagacagccttttaaaatgtttggaaatttacagcaggtatccctctccttcacagtcttttaaccttgtgatgaaatacctccagttctcatcagccatttctcatcatatggctacagaattcttctcatgatggtcatcctcagctagaaactgtctagacggggtgatggatacatgtaccccatcctttgatgttgatactatacttaaaataatgcagcctaaggttggattagctttactgcactgcactgttctctctggaccccccagatatatgttatgatttttatgttgtatgaacgaagaaatccaattcaaataggctgacgaagtaaaaataaagtttatcagcctaattgcttatgcaactcaacagtacaggagtaaatgcggtctgaggcagtgtttaaacaatgtgatcaggatccggttttcctctttccatttctcacctctacttccttggtttctttttttttttcttctgatctcttttagtcccaagaacgctaacggcctgcagtcttagggttctatgctcccttagttatgagcagtagtaaaggagaagtcttctttcttaatagttcgaatgaaaggccaagaacggacgaccatcacggctccaacatgaagccacctggctaacatgggtcacatgaccagggaaacatgacttttctagctttagccaatcacagacagactgcctctgtggtcaatcacatacacacgacatggctaggacccatttgaagttatattaagaaagaatgcagaaattaatgttattggaaaaaccaaaaataatctactaaacactagaaaaatttctccagcctattattgaattttacttccaaatgaagacttttccgtgtacccctactcactttgatgccaaatgcttctgattaaggaattaatttgaactttggttcagctctccaaaagattcttctctgctttgaatcccttccatatttgatatacataacttctacgtattcttctcattaagtctttgattaatgagaaccattaagaccaaaaaaacactgagctttgaggcatataccccactgcgtatttccccaaaggggtctatcaatctgtgaaagactatggttcagaaatagctatttaaaaggtataaattaacctcactaactcctatttttccatccataggaaatgtgccaggagacactatcaaatgccttgctgatatcaaggtgcactgtttctgtagcatttccaaaataaatgctacattttgtagcattctggctatattacttaatgcctgtagccagaaggagatagcacacaggggaactggagaacctccatagagtatgtcacacactgccatcaggtacatcaggtcctgacataatttctttgctccaggtaggacctcagctgctttctagagatccatcttttccttttccagctctcagacttcctcctaaatggctggcttgtgctctggtccaagtgggtcctgctgttcccttggaaattctaagaacctgctcttgcaaagctcaatccccagtgcataacataatggcggagagctgctgcttccttctctctcatgtaattgtcctttcatcagtctttttattggattctctttaccatctttgagtcgttttctatctgaaatgtttattagactatttctgagtggaatagtacagtggacatctattcttctggtttgtccagagttcacccaccctcctaggttttcaagaatgtctgtcccatttcaaacctgcatttttggcagggctgccagcacctcatctccctcggtccaggcagggttgggtgtgagacccacaaaggccaaagccatccatcccaaatacacagtttttaaatctggagctggagggaatagaactttttcttttgttatacagatagcagaacatgaatggggtgggggggaagaagctgctggaagccatctgtctcaccacgctgtggacaagactgtgaggaagaatgaggacagcatccaggaagggaaggaaggagggagagaaaaagaacgcaagagcaagaaagcaaaggagccagacgtcagtccgacggcccagactgcatccctgaattccatcgcagtagatctgtggctggctgtgcagtgtgtaggcaacagattctactctgcgtgaaggtgctcaggtggatttctgttacttgtattaaaattagcatcacagagtcatatggtaggaaaacagaatggtatagtggaaagaccactagagccctctgtagtgtagtaatagtttatacttttctaacaaagccaatctgggttcaggctgactcaaatgctttaaaaaattatagccaaaataaaataaatgaatccatggcctgagtttgaatcttggctccgtcatggagtgtgcaagttactaagtctcagcctcagcttctgccacagaggacaagagaggttaacatccttctcactctggctgtgaggattagaaggacaagcaagttgcttggtccacagtagcctcttaataaataacagcaattacttttcagttaaagaaagttgaaaggtagagtccttaaagtcctttcacctactcccctagaaagatgatgctaaccaatagctggcagatgcttttatgattgttgaatccagtttatctcacgttgggaggacattacggtgctatttccaattacaggtgagagcagatttgttcctctttcatactgaagggcagtgttattatgattggtgtcctttatgcaggaagagcaatttccatcatctgtttccctctttgcagagcagggcactgtctccactcctctcactactcccaagcccctgctctctccctgttcaaaggctatggctggccacccttgctacttcagttccccagaacctggctgggccatttcccttaacacatctaacaataagaatagtacacatttttccattctatctcacgagctcaagagctttatactaaccagcccagaagatattttccttgctctaaataactgtaattttgggggtcatttataccccactttttatttctttcaaggacctcttactgctcattataaatgccattatccttctctacaagcgatcaaatattataaggtctgacaagttagttttatgtttgcattgtaactgaagtcccatccatctatccttcgggagtttctgaaaactctatatgaacttcactcaaaatacacaagtagcatgtaagcgtgctgatcatattttcaaaattatgaagtgtgtcctttacataaaattaaaatgggttttaatgtgtttgagtcattcaaagttttatccttcattacccatttttcaggcccacctgatttcttttggctccctacaggggaaatgggatttctttttttcctactttctcttccacgaggtgagaaaaagaaaagagagcagcttggtagctgcacggaagccaaacaagagactgattcaacaggagaaattcaatgcatcccaaaagattccctaggaatttggtatcctgctgcttagagtacaatttgttgtaataagaaactgaaaatttttctatcaggaaagtcaaagtgctcagtgatggcttgttcaagttaaaaaaaaattgaactacaatggaaaatgtcttattctggaaatgctttcacaacataggaagcctaaacacaatttctcaaatcatatatattgctcatacacactggtcaacacaaacaaatgttttcctgttcaggtgacctagccccatacatactggtgaaccacaaacaattaaatgttttcctgttcaggtgacctagtcccaggagtggagtgtggcttccatcttattccacaaggaagttgtttatactgaaagtcaggcaaatgcaacagagataaagtctttttttttttttggagacagggtctcatgctgttgcccaagctggaatacagtggtatgaacatggttcactgtagcctcgacctccatgggctcaagtgatccttccttccacctcagcctctgagtagctggaactataggcttgagccaccatgccgagttatttttttctgtgtgtgtgtgtgtgtatttcttggtagagatagggtttcatcatgttgcccaggctggtcccaatcctgggctcaagtgatctgcccaccttggcctcccaaagtgctaaggcctacaggcatgagccaccttgactggattttttgttgttgttaagagacagagactgactcttaacccaagttggagcatgtggtggttccctgcagcctcgaactcctgggctcgagggatcctcctgcctcagcctctcaaatagctgggactacaggcaccaaccaccaccacgcccatctactttttttatgtttagtagagatgaagtcttgctgtgtcacccaggtctgtcttgaactcctgggctcaagttatcttcccaccttagcctcccaaagtgctgggattacaggtgtgagccactgtgctaggcccacaaaaggtatttcttatgtcctggcctgggttggtggctcaagagccaagcaaggtagacggggaataagtggggttggtccacagctgtgggattttggagtaaagggaaacaggtatccttgctgcaggtagggaggagcagcagaggagaatgtagaaggtagacagtgagcagagagaaagtatatgagccagaatgaaatatctccaaggaggataggccagacagaaaaacaaatggattctgaagacagatcctggaattagtatctaaaacattagagttcaggaagccttttaggaccacgagcatctatgggctgggtgaaagctatagctgggaacttctgttttccttggatactgcaaccaaggaggcacaggactggggtccctccaggttggacaaaaactttcactaggaagttatccaaaggtacaaagtagattctagtggctccctcctggtctgaacttttcccagtagactactgctacctagaatgactcatgctgttacaggaaatccagcagctccccttagcacatggttcttgactgggagcttgagtgttaaaagaggggattggattatcagaaagagcaggatttggtgaaagtcaaatggaggaatttggcatcgggaggatattttacaccgtgctttaagataaaggtttgaagacctccagttaccttgagggggtttggggggcagatcttccaacttccagcagagatgagttatgtgtatggaccaaaaggggagtcaggtggcactgccacttaggagagttctctagaacccagtgttgatcagtgtacttcttaccagaacttgggcctctctaaggtggtaatagtgcaggattatcacttctgatttgaaattaggagctctgctatttaccatctttattttatttattttattttatattatttattttattttgagacagggtctcgctcagtcacccaggttagagtgcaacgacgtgatcacagctcactgcagccttgacctcccagactcaagcgatcctctcacctcatcctccctggtggctgggactacaggcacatgccacctctcccagctaatcttcacatttttagtagagatggggtttcaccatgttgcccaggctggtcttgaactccaggactcaagcaatatgcctgccttggcctcccaaagtgctgggattgcaagcgtgagccactgtgtccggcctattcactgtcttgatgacagagagaaaaggtatgggtttccagggtcctggcatagccagggaagagtataaaaatgggtaggaattatgtataacttggggtttggggggaaaaaggaattgatatccttgtcccaggtaaggatgggaggcaaaggaggggcagaaatgagaaatgcaagtggaatcatgctgtcacaggtcgccctggccagatgtaaagccactaacttcatattacaggctttcttggctccaccccacacggtcctggggctctcagaaatgccactgcacaatttttgttgatacttaatcacttggtcagctgtaactgtgtataaagaacccgaaagtgttttaggcagattatttctcagggcagaacctctattttacacattattttatagtaaaggtaggtgagagtttaagtttgattctaaagctatcccaggctgggttcagtggctcacacctgtaatcccagaactttgggaggccaaggtgcgaggatcacttgggcccaggagttcaagactagcctgggcaacattacaagaccctgcctctacaaaaaaaaatttctttaattagcttggtgtcagggtgtgtgcctgtggtcccccctcatctactcgagaggctgaggtgggaggaacacttgagcccaggaagtaaacactgcagtgagaagtgtttgcaccactacactccagcctggacaacagagcaagaccctgtgtctcaaaaaacaaaataaaaacaaaatgaggctaccctaaaatagctgcataaacaaagccatgtcaaatgatgatattcccccatcagtgtcccctggactgctggcttctgggagaaggcatcctctggtggccaactagcacccatcaagctggtcatgagcacagcctccagctttacgccagtcactccaaggcctgagcatgctggccctggcttctgggtacccttccagctcagaggatgacagtgtggagctaaacaggggtttagccatagggagggctttgggaaatcagaggcactagattctctatatgaggctttaaaatagtagaatgatgaatgaaatcctgaaaatcaatcggggacctccaagagagataagtacttgatccactgcagggcctcctactctagcactctaaaaaccttgtccatcactggccaggccggatttggtccagcaattcctcctcaggttgtcaaaggcctggttttctggagatgctcacaggtgcccctcagctggctgttgaaggctatctgtaagctccaccagaatgaggactttgtattgcctgtttcgtttaccacagtgcatttaagtaggtaggtctccataaatatttttgttgaaaaggatgagtaaaagtgcctgacccaggaatgtgagatgtacccattcaaatcaactatgatctatacatccaggaggccatgcagtaagctgagaatcaggtagagaagatgggcaggcttctttagtccaaatgatatctcttgctctgtctcctaccggccaaggcatatctaaaggccatattcgacttcttgcatacaaataagatggaggttcctacagagatctgatttcctaaagccccatgcctgctagcattgatgtggaaagacacacacagacttggggcaggacgacagctgcacagtggagctcataacggggacaggggaggaacaagcagcttctcaattctcttgtctgaaagtggctgtggactatatctagcactcttgctacagggagagttaccagaataaagttcagcagcaggttctggcaatgctgtccagagtgaaacagaagatggggtcctctgaaagatggttgagtagtggcctctactagccaggagtgaaacactatagagatgtatggccaggaggtgacggaaagcacaggctttatgcatgttctgccatgtgcagcagcatgttggaagcaatgaatgggtcacctccccttcccagtaggggctacacatacatcagcagcacccaatcattttgtttcatccttaagacagatgggaaataggcaagctggatgaaggcatggtatgtgaagctgccagatcacctaagcctgtctgctgtcatccaaagctctgtcagaatgtgcaacacttgttcaaatgcctgaggtgacagcaatggtcagaagagctgctacattcaggagaaggagtaggcccaaggcaccctgcctcctctttttcagaggtgttgaagggccagagcttatgccagttccatgcacagagtgtcctagatttttcttccagaagtaagactacaaggctgggtcattctcacaccaaccagtaggttcagtgctggaaccactccacaaagctgggcaatgaaggtctttacccaaacgtacaggtggcatctcaagcaaggtgattagggctaaaggaagtcaaggtactttagaggagtagatggctgaagcagagatgttctcatttctcttgttccaagaaaagaagagccagagaaatcggtcataatgttctccattacctcctacctaaaccctcatattagccttggattatccataaaagtaaaacataagtaatgaggcctaagcgcaagtcagtggtgtaataaatatctactagtcattgtcatatcttctttccttcttcttcatcttccctctttctctattttcccctctttcacctcctttttcattggattttatgtctagattctgcattaagaaagtctttcagaattaaattaaaaggcttatatttaaaagtttttaaaaatgcttgggtcttgacggacccttcgcccatcactgtgcaggtgatcacggccccagtgtcccagtaagaaataaaccttacaaaatggacagcaaacagaaagaggccctgattaggcatgccagataattcagtatttcacacatacgaacacacgcacatacagagctcagagtcttgtatcgagggtcttccactaaagatactttaattgaaaactacagcatggaaaacatgattaagtggctacaagattactgttcactttaataagcagagaagaaaacatttattcatttatcaggtgaaataattctctaaatctcatcagagacaataaatggcaaacaacatacgtggaaagaatgttggatgaagttcagatagttatttcttcttctggggtgagaactggctctgagttgttctctaggtcctactccatgagcatggattaggaaaagttctaaactagatacaacagccaaggacccagcctgccctctaggaatgagcttcgttgtcagagacaatgacacaagcgtcctcagagagcaagctaacaacatctgagcaacaaggagagatgcgggattgggagaggcagacccaaagcaagcgctgggtatgtgacggcatcgaacgcgcgctcaggtcctcccactgtaatacgcacctgggatgcggggtcaggaaggcaggcccaaagcaagcgctgggcgcgtggctgcaccaaacgtgcgctcaggtcttcccactataacatgtacccggcaagctctgcagactcctgtaccagaatgtcacactgacaaaaacccatgaaagaacaactggagttcttcagaaaagcctgcttgaaaacagtagaaggtactgttatgaggaaatctcatagtttatcaacctatcttccaaaccttctcaaaaaaaggagaaaaaaaaaatcccccgcaaaattaaaaacgaatggggctgctatgtaattaactgacaatctctcagttacaaacccctgatttgtaaccatggcaggtacacaaactaccagctgcattatacttccactctctccacctgcccccattttttctgacaacaaagcacagaaaactatctgagctgaaatctcactcttatcagctttcttctccttgatggagatttcatagcccacctcccttgcctctttctctgatcacaacttaagtctcttcatcattcttgttcttctgcctttttcccaggtacgtcacaaaagtgtcattcccaccagcacaaaaatactatttatggacaacaaaattaatatcaacaaatcttaccctataatgtgggctttgatgaaagaagagatgaaggccctaatacgttttgaaatggctttagatcagaaacaacggaagtcaacgtcatctcttctcatattttcttgaggaaagagtgacattttagtgtgtgtggtgggggaggtacaatttggaaatggttatccaaatttaaaataaatataactttcactttaagagcagggggacctaacttttgatgtaccaagttaccacttaggaatttctcatgtggatttaccctatggattcaattaatcatggcactgtttgacacagtacacataaatggaaacgacagagattgatctaaaaattatggcatatccatgagatgaaatactatgtatctgttaaaaagaataaggtagctaatctggagctaatctagacagatgtctacactctcttgtaaagtgaaaaaagttacagaacatgggctagggagttatccttttctctctctctctctctttttcccgcacactaaggaggacctttggcttggcttcccttccttttctctaatccccactcctccatacaccacctcagcaggcatatttaaaagacctattggaaatgagtctttcccccagcaagacaagcaggaaaaacgcagaagtgcaggagaaagtggaagagcccacgtgaacagttctgaagggaagagagttgagagtaactgggaaagcagaataaaaggaatgggggaagcagggctttaaaaaaacattctgtgtattatgatggaaccattgttcatgttttctggcgaaggttaggattactgtttactttcaatcctctgacaccatgctaagacggaggtctatctggctctggaatatattcagaccggccactctcacacggaacatttccagaaggaaacttttagccatgtttatctttaaggagtgggacaacagtttgaagatgaggctgatttttacctttctgtcctcttaaattgtccttccctacaagcatatgttaatctcgcaacagaaatgaacagaacgggcgaatgtcctgaaagtcctcttcaaagccggaaacaccctctatatctccttatcactctctagttccgaaagaaaagtcaaatttaattaatattcgacgcacaaaaattttaaaacaatgtgctcaattttgtatttttctctccgtttttaggggctggggggggaatttatagcccatacagtggtgctatcaaaggctgagtagactttcatgggttagtctggagacatcaccataatctgtaaccatctttaataggaaaatgcatcccaagttctgaactactaattggcgaattaacattagactaagttaaacttttaaataaaatttatgaagtattttaaaattatcttcattctacttcctgtttacaatgctaagggacagatgagtttccatattagtcacatatatatgccgatactatcagaagacatactatgggctaatactaaacattatacattttgttgtatgtgatttctaacttgttttatgaaacatgaaggatgtaatgttgagttgcgtcataaaaactgagtaaaatctattgagtaaaaataaatgagagtagcaagaagggagctgaaggccataatttggattaaaatggaatagcagcactttctcctctaaggtcagcaattaaaatttagccaaggtcaggagtgacaaaatcatcaagaaagacttgacctccatctagttgttgcaaacaatatattaacattgtaaaactgttacagcagatggcaatgcaatcatcccttggtaactcatgcctagctaactgtctgtgtccttggctaaaggtgagcaaaaggcccacctcctgcgtctgcagggagccgatgcggggggctgagagcactcagtgtgaattccctcatgcacatgtgagaggtgaaaaccactgccaacttctccattcctgcctttgttccaaaattgctaacagggttgcagggtacctgacctatttgcatacattccttatttttacctctgcctgagctaaaggggaaaaaggcaaagtatgacaacatctaacctgcccatttctctcaactttgttggttctggtttatttatagccttttcctcaactacagctttaaaagcaaatgattcgtacctcactcatgtgaagtggatcaatgcagattggatttcttgaaataccaccaaaaagcaactcaacacacgccagggaagagaaaccaagggaggcttggaaatttgtcacccagcataagaacacagcacacacttaaagagattgtgacctgccaaacaccatgtaaatataaccaaacgtttcccaaacataatggactgtattctggtggaggacttggcctcacttacaagaaaggcctctttgtttaaagtcagtcaaactgccagctacttaaggtgtaagttagtgcctcaaagaggccctggtagatgtggggaagagaaggttgcaaaatacgtgcagaacagacacccgtgtaggtgtgtggtcttctttatggatgtggtggacccatgtaaagtttctgtgcttaagagtggcccgagcagggcagcctgagtgtcgaaagggaggatgaggcagaagaatcagtgcagcgctagccaagagtgaggaaccagcagctgctgttgggggcctggagaaagaagggtatttttcagtctgcatcttttggatggagtttatccactcacccagaggctgtttggcttcctcagagcaagccctggagttcagagaggtaacgccaaccatctgacctgcctctttttgcaacactaaggctcagagaggaagccttatctctttgaatgcgattcgtattttccgagaacccacaagatcgatcactctgagcaggcatttcactgctcatgggaaagtctacagtctcagccctcaagccaatccctcatacatttgattaaagctgactcacagtctggattccaaagctgttcacccacaggcagtggaggaaaccatctacagaagtcccgaaaacatgctcagggtcaggctggtggcactggctggccagggacctctgccatccgcctggctggtggagcctctgccgtcttcggggtccttgtggactgcaccaagctcctggctcacgcctggcttcctgaccaaacacctcatttctggtttactacctttgtccaaacaaatatcctagaccctggactcacttctgttcttatgttgaccctgggaaattcctctccctctagcgggaacaggaagtaccctggactctcacgtttccacctgctcctcttcgcttacagccattccctgcctgttgtcctacgttgcccctttgggctgacatggtatttgcacagtctgcaaagctgggaaattaaagatctgcccaggttggagcccctgttctccagggacctcctccctctgccatcgctcctggtcacaggtgctttcgaggtaccttcccgccagcaaccttgttctgtgctagagactgagccattcccacctcagattatggtccacatgtctccgtgcccttccccttgggctgctctccgtctcaccttctagaattatgttctcagccgactgcaaatcagggtgcagcatccaccagcgcctaactctcagcagttcaacactacccccttcaatgcttttctgagttataaaaacatctcagggcaaaacacctactggtctccaggagctgagatcagtcaagaagcaattacctatagttccttcacctgactcaaggagaagctgaggcagggccgtctccctgctgtcctccctggctcacaaggtgattatgaaggcaaatgattcaactgaaagcataaatcctgagagagataaaggaccattcttactgtcagccagaccaagggccccatatggccatcctcacctggaccagcagaggctcatgacacagcctctcaagctaggtctgagcctgcgttcctctacagctcccccaccaccctgagcccgtctttgtcactgcaagcgccacatcgtattgtaatcatctgctccagatagagacagcatctaattagtttctgtacacccacggtgtctgacacatggaaggaactttacaaatgatgaatgaatgcataagtgaatgaacaagaggagtgaataaaataagacttggttttaaacaatggttgagaagcagctggaaatgctccatgcaaagtagtaatcagaatgacttcacaacatggatcctttgcccaacgtgaagacgtcctagcccttatgtcagccctctccctgggacttgcctgtatggctccatggtccgagtaccatagaacaaggcttcctccaacaggccgaggttgatgcaggcatccatggcgcagtcgagcaccttcagctggtagatgttgatatcgggaagccgttcagaattgctgcttatgattgcctggcacatggccagaacctgctcccactctgttattaaccttagttaaggattcattgtcttcatcaagaaaaaaacaaacaaaattagattctctaaaaggctaaagagctcccaagcacaggagcgagggaagcacccgttatttttcacagatgagctgcctgaaaacacacttgagaagcaaaagcacagaagaggcatctcagtgaagtgaattctgtttacatcaacaaactatctcgtaaccaggcctgtgctttggagttttaaaacttccaaagacctgttcttgcttcatactcctagatgtgttctctttaaatctagtcataaataaatgcagtcctttattaaattggactaaagattaagttaattcgattttaaattatttactctgttagcttctgtttaaaaactgtttgaaattaaagatgctttagagagattcctttttcaaaaggaagagctcatgtttgcttctgtgttacctgagttttgggcatacatgaacccaaaaactcacacaacccacaggcacacactaggtggagcaatttgaagacatagatttccactgggtctcattttttccgattataaagcaacagtgaccccagcctgtacttaaccaaatacattaaaatatgttattttaaacccccaaaataagagacagtattaggaacatggcttatgcacatcaattgctggcaagggaaacgatgctttaaaaaggatggggagaagactcaatgtccacttctcagtaactgcctttctgattaaccatgagtcagtaacttcatctcatgtagccttggagtgacttcgctttttaaaactgatattccctgtcttacagaggcagtcagaggactgaggacatggtttatggagcgtaattttaatccctccccagtgaattctctgggaaacacagcgaaggccagagtgcaggaccctgggacctcgcagtttcttcactgtgcggtgtgttaggcgagctggagaccaaggagggtgcaggactgggactggtccttctctcactcctgtctcaccttcacccagtggagctccaaattcatctgcttcatatgttgtcattccagtagggtgaaaaggtttgaagatcagaaatggcagcctagcctttgactgtagtaaagctagattcagatctaatcgagtcctgtcatttatcagagttgaggttctgaggaagtcaaagtgcttaatgataggccagaaatagaaatgactcacgtcaacgtaagaatgagtaatatattgtatgtaaaatgacacagttcatgatgtgtcctctcatgagccagggagagttccaggtgtcagagacacagtggggaacatttcgtggcatgcacaaagcacatgctacacaagcattagtgccttccaccttccctctgtgacatgacctctgagcctgactgggcttaaagaaagtggttcagtggactgagtttgactgaactcagtgcccccttcgtgcccccacacccctcccactcccacatgacctggtccctttacaatccatgctctctgtgccatcccctgcccccaattcaaaaccctcttcactgaggtcctaacagagcacgcccagccctgagcagacagctcactgtttatggtcccctctccctctctgtccagcaaaaccttcctcttcgaatgtccatacccttctcagaacacggctttctgaaacattagcaaatacttctaataaaccaatcaagccactcctgagagtggagacaaatacctttatgaactttcacagcaaatgtattttctttccagcaaaggcctcccggagacacagtatcttactccaaaagatgagttccttgatgagaatttaaagcaccccaatgcacagctgagagcctgttccatcacacccactacaatgttaggatgagtcccgtcttggaggaattgaccctgatcccagaaaaggttcatttcctgaagaaaagcgagtgcatgatttgctcttgcattcatctgacatgtatgttcaaagtttgctgaatgtatcccctagaggttgggggaagcagtatcttaggcaacgcactgattttgtaacagattgctgggctaacctccgtggcttttcattccaggattagatatttgacgaactgtcaggaggaatgactgtctcttacacattgctagacatttctgtggcaagacttgtaccttattttaacattgtgctgtttgacctccactattatttgcctgttcatttatgtatgttcccacttattctaaagaggttcgaggtgacaggccttagaagtagaagccagatgtgatgttctgcagctactcataggaatgcatttattttatcccccagcaagctggaagggactacgtgccaatttcccttcacaatgctggcaactgtctcttgccaaacaaggcaaaacctttcctgcaaaacaccccagtgagccaaaaaatggaataattttaactaagaggcttttccccccaagctactactgacatgtatttgctcaaagatttagtccctggcatctgtgtggtgtttactacaattcactctgttccagtacggagctgagctctagacctagcagggctggagagtgcacccaaagagaacagattcctagtggacagaacggatatctttttttcctgaatacttttaaatgaccataagaggatcaggggaagagaaagggaagcaaagtaaattcacttgggaattactcaacttactgagattcaatgactgtcagaccacagagcttttattcacttaatcatattactctactgcttaaaaaatcatcccatggcctcctctcacctataaagtctaaccggtgcatggcagttaaggccttgccaccttcccctcctctcatattgcacagccagcagcttctcagtagcaatgcatgttctgcgcgtctgcacaggtcattccttgtgttggatgcctcttctcttggttggtctggtgaactcccactaatcctcccagacgcagctcactggtcacctcctctgtgaaatctttcaacttcccaaagttgactattgtgtctttgatgccgccataagtctgtatctttaccaaaatatgtattaatggacattttactaccccacaatataggagagtagtgagtgcagggctgtgtcttctaacttctgtctgaaccatcaggtgaatgatgaccagcaaggtacccagcacacagtccgttttcagtaaaaccttgtccagttgaaactgaactctggctgggttatccatgggccccaataccgctgccagggaccacacagaacaggtctactcctctgcacataaaggctctttgagcccatgagcagggacctcctgcttccagagttgactgttttccgttttcctagtatcttccatctcatcatagacagcgtttcaaatccctccttaatttcagttccacccctcaaaactagtttgtttttctatatcctttttaatacttcccacctcaaactgaatagaaaattccagaaataatcagactggtactatcatctctatcattttataatcaatattaatgcagcccaagatcacagtactaagattatattatactcttaaatgttgttaaattttgctatttactaaagccctaaatttttttcacatgttcttatgcatatttacatatttgaactttttgatccgaatagaaattttatatatgttcttgttatatttcatgtctttaaaacttggataccatttaaacatttagagatcttttgaactcttttttttctttcgagatactgattctatcatcccacctctattatcctccccatctacgtcactttggagatttgataaacctgtcctctgtatcttcattcgaggtatggaattatgcattaaagaggcccgagatggaaaaacaacactccagaatgacactgaatcatgtaacatcattttttcagtgtagctattcagttagctttgctaacatctaatgtaagtttcttgattacttttcgtcaaatccctttctaaagtctcgatacaaactttaccaaagaaagctgtgactctgtggattcattcgctcttggagaaaccaggcagcactgtgatgatcacagctttcttttccattccttagtaaccaatcctagattctttacccaagactgctaataaactcagtgggctattgattcaaaattatgtccttcacctttaaaactggaaacctccctctacctccttctctggctctttacaactctttaaatagcatcgtcagcaaattggaaacctcatctgctatgttcttagtgcctgggatataaatttaccccagagcctctgaatgaccttttgcagtcttttcatccaccttgatctcttccttcttgcctgctgtttcccttcatcacagcttcactccaatgaactcctctaccaggagcggcctccttctcagccttggcctatccaaatcctgcccctgactcaggctatcttgcacagtaaaacattagtggagccttcccagatgaccttcatcctacatggtctctccttactctgaactttggtccacctgtggtcattactattcatgctgagaaaatgtgtcgtgcagcaatccccactgccattgtagtcgtggctggtttaatatgaagcttctgggtctgacggtcaatggcactgaatgataaggattctaagctactctttcctagagatgttagtggttatgggagaagaaaattgaggaatttgttaccttttacatataaagagactaattcttactttcctactactgctaggccatgagttttgattattacctaacggtagtgagttattattcacgctgattttgccacgaacttccttgtcattactcaaactgctggccagggtcggaggtgcggcctgtgaccatggaacagaatgaaaaccactggctcatggagaggtcaaaccccgcctctgacctcattacgacagggcttcaagaaaacaaggaaacaatcccaacagtccacctcaatccacaggcgaaaggatactccagtgtgccttcagttcttcaatttttttcagggattcttgaacttccttccatacttgctcatcaccagttagcatatcagcatcctgctcaggccagaaaaggaagacaaataatctaattagtaataggcaaaggacgtgaatagacctttctcccagatatacaaatggcctgcaagcccctgaaaagatgcttggcatcatttatcatcagggaaatatataaagcaaaaccacagtgagatgttacttgatacccactaccatggctataatcaaaaagacaggataacagcaaaggttagtgaagatgcagagaaacggaaaccctcatacactgcacatgagaatgcaaaatggtagctttggaaaacactctggaagttcctcaaagggttaaacgtagagttttcatgttcccaattagagttaccatattaacagtcctactcctaggtatctacccaagataaatgaacatgtatgttcaacaaaaacttgttcacaaatattcacagcagcattgttcataatagccaaaaaatggaaacaactcacacgtctatcaataaaatatccagacaatggaatatgactccacaataaagtactacatgctacaacatggatgaacctttccacaataaagtactgatacctgctacaacatggatgaggcttgaatacgttacgctaagcgagaagccaatcacaaagaccacatgtatgattccatggatatgacatgcccagaagaggcaaatccacagagacagagtcgatttgtggttgcctagggctaagaggattggagggaactggagagtcactgctaatgggtaggagtttcttctggggtgataaaaatgctctaaaattgacaccatgctagttgcacaactctgtaaagagactgaaaaccactgaactgtacactttaactgggtgaatttcatcacaggtgaattacacctcaataatgctgatattttaaaaaaacagaagaataggataaatagttatttgttaggagacctacagctaaaaccttattaagtataaagtacaactacacccatgtgacccaattctgacttccacctaaactaaaaacaaaatcccccaacactgaaaaaattcaaaagaaaattatgagctaccatgtatgaaatgtctgccctcctattcagtaagcaggtcctctgcttccggttggccagtgtacgtctggcatctagcacagtgcctggcacatagtagttgcttactcagcacttgttgaatgaatgactgaaaaccacatgtgtgcacaatgctgaaggctttactgatatttactgatattgatatttactgatatttactgatatcgtcttatcttcacatagctcttctatgtatgtaagtatcttcacatagctcttctatgtatgtaaggtcaaatcccatggggtaacacaggcagggagtggaaaaagtctaccctgggtcaggcaatgagagggcacactgtctatagaatactaaaaaataataataaaaaccaacgaaaagtaggtctgatgtttattatgtgcaacaattcagaggtgaaatattcttcttccccccaggtcagagggtgtctaacatctttctccctaatatatcactgatcatacccagtttatacatgacaaaactgagactcagattaagtgacttacctgacaatcactagcctggaaccaaaatttcaccccaggtctgtttgattccaaaaggctatcttcttgtcaaatattactctgtttgccacagatactgctatggtcttttcagcatgctcagcaagtcctgcttatttaaagctgcactaacaggtagccaccagccaggtgtggctatttcaatttaaattaattcaaacaataaaaaactcagttcctcagctgcagcagccacattccaagaagctaacagccgcatgcggctgtggctaccacactcaacaacccagatacagaacagttcactatgtcattgcagaaagtcctgttggacagtgctgctttcaggtggctagtcaaagggtaagcactcttagaagacactattcaaaaccaggtgttcactatccatgagactttcaacgggtgtcagagacaagaaccaccctaggaagttacatgaaagcagggccagtgtgaaggatgacataagggtgaggaacgagggacattttcatactctagacatccccctggagactgtcatgtgcccgttgaaggaggtttatagaacgaccccatgagaaccactgccagagtcagtctgtgtttttgggaagaagaaatatcactcaagtgtgccagggcagaaacaaagggaggggcagagcaccacgaaccacagaaaacagatcctgagactctccttctgaggctggggcagtgggtgtgtgtatgaggagataggagcacttgtgtctgcataattgggctttgtgggcctctatgtgtatgtgctgtgtgtctgtgtgatatagtagagtggattttaaaaagacaccataggtgcactttttttttttaattctaaatacatccctaactttctgtacatggaggagggaggagataaaatgcccttaagaaggtaaacaacaggctggatgcggcggctcatgcctgtaatcccaccactttgggaggccgagacaggtggatcacctgaggtcaggagtttgagaccagcctggccaacatgacaaaacctcgtctctactaaaaatataaaaactagctgggtctagtggcacacgcctgtaatcccagatacttgggaggctgaggcaggagaatggcttgaacgtgggaggcagaggttgcagtgagccaagaccacgccactgcactccagcctggacaacagagcgagactctgcctcaaaaaaagaaaagaaaagaaggtaaacaacagtctcccttcaaatgcctgctttaagcccgtattcatctcctaaagatcacctccctctcctgcaccaaagccttcagcaacttcccactgcctcccagatcaagctcacccattagaccttaacaatcatggtcattcctgattgaatgttccagttttacatttcacaactggcagcttaaaccctagatctaagcaaaatgttagtctctatggtaagcagaataatggatccccaaagatgtccacatcctgctctccaaacctgtgaatatgttaggccacattgcaaaggggaattaagttgtagatgggattaaggttgctaatcagctgaccttaaaatagctgagagtatcccggactttccaggtgggtccaatataattacaagggtccttagaagtagaagagggaggcaaaagaggaggtcagggtgatgtgctgtgagaagaacttaaccagaagctggcaaaggcaaggaaccagtcccctggagtttccagaaaggaaggcagccttgcccacaccttgattttggccttctgagacttgggtcaggcttctggcctacagaactctaaaataataaatctgagttgttttgagatgctatatttatgatcaattgttacagcagccacagaaaatgtagtccctaacataccttctgctcctctggccactggggctctttgtgcctggccctctctgtacctggaattacttagttagatcactcatttattccattaacacttactgagtacctaaccaggcactgttctaggcagtagggatagagcagtaaataaatcagataatcatggtgttcatactgaagaggcaggtggaacacacggcaagagaagatatgtgcatgcgcgtgcgtgtgcgtgcgcgcgcacacacacacacacacacactcacacacacattttgttgggagaaaaacaaggaagagggatggggaatactggcaccagggagttcattttaaacaggatgatcggggaaggtctcaccaaagtgatatttgagtaaagctcatttaaaggaggtgaaggagtaggagacagcagttccaggaagagcggagggcaagtgcggacgcagaagcgtgcctgaatgttccaggaacatgaggccagcatggccagagcttgtggactgcagtgtgtgcatgtcatatcttccccacttaactgtaagctctttagagctgaatataggtcttattcttctttgatcctgcctctcccaaatatctagcacagtcttatatttaacaaatgctctgctgaatgtctatagcatggatctggaagaagtgaactaacttggtaatgatttgatgtctcttgtgtttatttcagttattcctcacaacatctttgaaaggcaccaatacttgttatttacagatgaggtgcaagataatcctgaagcttacataattggtccaaatgtccttctacccctaattgccgaggtaggattcaaacccaggtctgtctggctccaaagcccatgctctttctagtaccttcatgcttcaatttgatttctctcctggacttgcttaaaaggtgaaactcatatctgagttaatcaattcaaaatatcttcacccttgtttcctaagctctatctagtactagcaattctaagaggagagtaaaatcctccaacatagaacccacagcagatctcgtattcttctatcaagcagggtgagaccgcagcccagggcagaacaatttcatatgggaattacagtcacaactaaatttgccaccagtgaacataacctgattagctgttcttttaggttgatcctaagcctttatttgcttaacagaagagcaagcaagctttgaaactgctcctaaacatttagaaatgatacctctgagagcattttatattggagctagacaaagctacactcactaatagctatcacctccctggagtgttccactacggtaactgcctctcaggttccaacttcccctgaccctacccatcccactgtggctgctactcacaattatgtctacactgggtctgtcacgtctcccctctctccacaccaggctggaggaaaacattcagttgcacaggtgtataaacaggacagaaacagaaaaactacttagggaagcataattttaatcttctactttcctaatttgcaaatagaagagtaaattactgttttttatcacagtccctgaggtataaaattagtaaatttatatccttatttccattatttcatatccaaacacaaagacacttgatataattcaggacaaagttattcaggaaaaaaaaaatctctttgaattttacttttaccacataaaaggagcttgaatgggtgagtcctggaatttttttttaggggatggaaacattcattttacattcatttaaacatcaaatatactattgctggattttctacaaatgctaaaaagaattcagcctagaagcagaaggattcctaagaaagctgactttcctgggaaatgatcgagagaatgaagaacctgctggttccagcgctggtggcatctctgccctgacccactgcatgaccccgggcaagtcttccttttcctggccctcaccttcctcacctgcagaaggagcagctagtctggatggctgctatgtaaccactctagtgatttcagcagtgcagaaccaatttagctccatctctggtgactgctcttttgcacagccccggagaagtccttcaaaagcctgtctttattttaaacagtacaatcgtagagctagtttatgaaagacagaactgtgccgttgttctcaggtaagaacgagtctcatttgtccattctctctctgaccgcacaagccccttgaataccgccctcccagttcactcaccccattctttcccctcacagctccaccccaaaatcctacccacgcccatctctgacttcactgcacccactcttccaactaaaatcgccatcctgtggcttctgtcaggactcagcgtgttttctgctgtttcctcggctcaccactccatttaagtctttggctttcttcccgtttgtccttttgggacacagcccctgctgtactctatcaggaaaccttctctggttctgccttctgggttagcctggccctccaggcccctctgcacagcccctagccctgaactgacacgaatggtttcctggattgcctccccaggtatcctcagaacgccctgagggaccgtgacctcatcatagctgtattcccagtgcctgcaaggtaaatcactcggtaaatatttggtgatagagtgaatgagaagtgatcttccacaacccatgggcgacagtattacaagaataaaataccttaactccaccacaacaaagagaatcccaaccaagacaacaggttgttcctttcacagcacacgtctaccttgactctaatattactacactaagatcagatacgttcccaccgcagctgtgggtatttgtcaaatactacagctggcattggtcatcatttagagcctaagtgtgacaccctcccccagcacaggaaaccccacgccggctccggacccacgctttctgacaatcgcgtcaagggttatttggggagtgggctcgcttacctctcctggcttctacctcaaacaccatcctgagattctaatggcgctcttggcccagaggtccctcgctccatctatccctgcatgaatcagtgaggccacctacattccttcatccatagctgctgaatcaataccccaggatcatttccttaactgtaaaaataggtaccagatgatatgagatcatctcaccaccacataaaagggtatcactcaacacggttacattcaattggccaaacgcttcctttgggtttcggagtgggaagtttacctgccagataccagtagtcactgtgaattacaaagctacgtttcttccatagggaaagtttggagtccagccaggctagctgagtataaacttgagaaagtgaccacgggctctgtcaggttaaacacacgaatccatccagacccaccttgcagctcgaacacttgaacagatgtgttcacttagcttgcaagcgtttgatgttgaaactcgtatgctgggccaatttcagatggttctcattaaaaagaagaggaacaggagaaaggtaatctgcttcccagtacttcctgttatccagtactcatgcaaactctaattagattgaagagagatggagtataggatgaaaaataaaaaattaatgaacacttacaaacttttccagtaattcaataattcatgtcttaaacggaagaaaggtttttagttttagtttttaaagtagaatgaggttcaaatacagtgtctgcactcaagagagagattggaaagtcttgaaattaaaaattctgaggtaatttgcagtgtctttgactgaggtagtctggttggggcaatatactgggactagattaatatacaacatcattcaaaacctttatgattaaaaggagacatctgtgctggaaccaatttccacctcctttgacaaaaacaactgaaagcagttcagatgtaacttgaggggaaaagtggctctttcataaagcggaaaaatagtggctaaaaatagagcattcactgttatatcaactacagaccagtcagtggacattataggctggggaataaggaaaaggaaggaatgttctcaggttgaagcacgatcaaattgtagtatgttctaattagcaattaatcagcaaatgtacacaacgattaacagaaattagtgaaaaagaatgccgggcttggagccataagatgtggaactgaatccctgctgcatatccctgctgccgagctgtgtagtcttggcaagtccttcaaccttccagaggcccaatttcttcagtggtaacgattctctaaggagatgcaccttctcatcttttcctctgcaccctctagagttacttacgtcctaaatgtcacagtggcctgagttttcaatccccaccctacagggcggggaccaacaggaggctgactagagtcagctttgtttggtgggaaagaaaaaaatggtggaggagggagcacattacaatgtaatcaacaaccaactatgctgtgaccccacatctctgcacatcccattccctttgccgggaaggctcttcctcaacgtagtcatccaagcaaacttctctgatccaccacaaaccacaccaaacagcctctgacatccacaggcacaatccctgtgcacttcccactggctttcatgatgcttgctctactgcctggcggcaatgagcgtaactgtgatgcagatgaaaagcatgtcttccagatgctgtcatcagcccacaggtgaagtaaaattggctttaaaaggttattttttcatctatttcatgaaattgtgggatctcagtgcctttaacagatgtccacaagcaggatgtagcagggctctgaattgtgagtccaagcagctgcttgcatcctcgcaagagcccaaagttcccgcctcctgctgcttcacccatctcctgagctggccgaccccaggatggatgtcctcttctcagatgagagagcccagagttcctgccgccttctccttcaccggcctccctgagctggccgaccccaggatggatgtcctcttctcagatgagagagccttctcccgtcgggcagccccgtcactcccttggatccaactgaggagcacttgggcaaccaggggctgtgagcccaatccaaacaaaaatgctcgtggtgaggagaagaagtcatcaaacagctgaagccactggcagctctgttccatttcactttacattcccaccgtcgctgccagcatttgccaaatgcccatttagctttagatctcaggcagaaacagggctctcctgcaactacaaatttccacaaaccacacattcaaaccaactgcgatttcaaggttcaatctccagctacacagaattgccagaaggaaggggatattcccttcatagcttctgggaaacggagcacagccttgaaggtatgaagtcagaacttctagaaccaccaaaggccttttccggctacagcctcaacacctcccctccctctgtgtggggttgttcccatcccagtgaataaaactgcttctcagagaaataagcttatttgcttatataaaatcaagtcaacctggagagaataaaaacagcatctacacgttgagggcagtttgagagcctacctcttgtcagtggtgcttgctaaaaatgagccttctgtagaaaagcattttgtagaaaactagcatgatgggctgatatacaaggcagttaaacacacatgaatacatttaggaaggagacacttgcttgcaccctccccccatactggaaaggtatgttcctgatgtaataacatataatggggattagatgacacagagggctatgagctccacttgcaaatgcacattcagacaaattcttttcacatctgtagagagactaccaaatggatggcttaggctgctgtaagcccatactcacaactcctacccaagtcctgccaatactgttgtgtaaacgctaccaggtgggaggtttgagattctgggaaaaatgcaaagattttacaggaaaattgttctcctgacaatagccattaagataaagtacacctccaaagttcagggtgagttttgtcttaatgaagaccaaagctgcagccctcatctcctttaatcggccacatctccatcttttgtattttcttctttgaggacagatgctctcattctcctctgccaacagagataaaaatgctttaagctgccgcagaacagattcaagtgaggtttaaagggcagtgtcccgaaggcgaaggttataggataacctagatgtggccactccagagacattcagacatgggatgaatgatagcttgatttgggttctgtgctgttggcatgtaagactgtgtgacaggcagcactacggaagtggaactaaggaggccgggccctggtaccagctctgccactggccagctgtgaggcctagagtctaacagtgcctcctggctccgcttgcccaggtgagaactacattagggttaccactgacatggaaactaatccttccactccattagtcgcctatgtgtaaagtatatgttgtccatgaaaacagacctgaaattctgataggaaggttgctggggtttgtgattgtgcaacaaattgtaaatgcctttgttctgatttgtccctccttcattctattttaaactgagttttctcaagtataaacaaccccagccatagcacagagagtctacaggactgaagacaacactcaacatggtactaccttctgccaaaccaagaatttgacaatggttatttaattcacacattccctctaacatttgtatgtataatgattataacaggcaatattccaagcttgggtaaacatggtatttgcttatctgctaaagcgagcacatcagattatctaatctgtggttctgaattaaaggaatagtttagctggggtccacaatgacagcttcacataacaagtccctgagacacaagtctagacatagctttttaggaggcaatcttacgggtcatctaaagaaatgatttattttgacattagaacctctctcttaacatcagttaatggagggttccatagcgtcccctaagtcttcagagttgggctgcagaaattatcccgttctacaaacacttcataaggcagcactgaaatccttagaccatgtgtcacacaagccaaaagttcaaaagaaacatgtcgctgttcgagggaaagaaattactttaatctctcagcctttaaaaaaaaattctagaattgtattttgtatctcactggaaaaaaagccagtgttcctccaattattctaaaacaaaaaaagaaaagtctgtagtctgtgaatcaatccatacagagatctgtcccttgaagctggagggtgggtcaccccagagggcagtcacttggcctaaaggtctggtgaggagaacactactttgtaaagtttgggaggagagaggggtgaccagattccatggtacagctcttttgtgcctcacctcgtatccatgagacagactacacaaaatcaccaggacttagacgctcctgcaagcagctctgcagccatggaagtgaagtgctggctgacggcacggcgagccgcttcctggcacgccaacagaaagcacatgtctgcatttttgattccagtaaactccaggctggctctcagccagaggacctctttgtaatgtcaaagataaaagtactggccatgtttggcaccctgcctccacctccattctcttgtaaccgtctcataaaccaagcatgcattactgttaacagagtcttccagacaaaggtctgacggagcttcataaacattagcagatgacgatcagacaggtccctactgcacaggaaggaaaggaggtacagggaggggcaagtgatttcactcagaacatgctggaaattgtggggagagctggaaatagatattcaactatatactcagaatactcctactaccagagaactgctcactgagccgcctgagtcgtgcacatcttccattagaacctggcatgtgggcaacatcaaacctcaaatctgtccccagcagtataggtatcatctttatattgatatctgatgaagttcctcaaatttggatgttcaaaatggctttttgagtatacaagatgatataatgcttctcatacccctaatattcttcctcttgcccaagggaatgctacgatgccagtcacagaagatttaggaaatgattaccttttgattagtttttgttttcattttgggtcatactcattgtgggccaaaattacacagccctagctgtttgcctttaccatttctgttttactttccatttaacttttgagactactctgaaagtaagattttaaggtttgtaaatgcttaccaactaaaatacgcaaggatttcttttccggaggtaaacaaacttacaaatccctcttgctctgtgcaagaacaaggggtacccagaccttcattcagaggacttaatatgagaaagtcccaggtcttcatcaccagtggaagctggatagctctggatgtgctttttaaaatatgtatcagaggctttaattcactccagagggctgcagagagcttacttcctcccctatgctaccaagagtgtgcaaacacacagatacccacagacatgcccacatacacacacatcccaggaatatgctttaagggatactgagggctccgactttccctcaaactgcagacctgttgttcctccagctttgtctctcctctttgctgtaagggcctagtaaggtaaggtgggtatatacttagaatcacctcaggagctgttaagaatacagaccgggttccatcgaggcaaatgatatcagcatctcttgggggcaggcagataccggtatcttttctaagctccccaggtgattccaatgcacagtctgggccaaggaccatcagcgtggcctttgccgcctcagccattgctccgaatctctgcgatcatgctgtcactcttcgtgccgacatggttaagacttgctgcaagtattgatggttttgcttttcttttttcttgtctgctcaatctacagttctgtctcccatgttctctgcttttgcacaaatagtttatttacaatagacacaaaagtgaccaagtctgtggcactacggggaataaatctcatgcccttcaggtgctctttagctcaatatatgacaacatctccccagtgcactccagggccaggtactggatctgagaagacacagctgagatgtggcctcagcttacattccagtggttgaaacggccaaacaaatgtatcatttctaaataccgcacgtgataacagagaggtaagccctggggctatgggagcatagaggcagagccctctgcctggccaggatttagggaaaatgtcctggagaagaggatgcatgagtgcaggcttggaggctatgggagcacagaggcagagccctctgcctggccgggatttagggaaaatgtcccggagaagaggatgcatgagttcaggcttggaggctatggaagcattagacaaggagagacaagcaggaaggccagtagcagagaagagaaagaggtccttggggaggccacgctgttgggtgcttctggttcactcatgcatggcagggcggcgctgcggagacggggcagctccccggccctctgctgccctactaggtctgcagttacttgctgttcagaggctgcttttccttagaggctcttttccccactaagctgaagggctacttcagaatgagcccacagacccaaaaacataaagctgaattaaacggttcatcgggggaaaggggtggagataaaggtttagatatgaggtagagaggtagggaaggggtcagatcaaagaatgaatttgatcctgcatgggcaacatggagacatggggagattttaagtataatctctatgtttttcaaatatttacgtggaaaatacacttgcaggtgggagggactgaaggcggaaggtgttaggtagatgtttcaacaatccagaaagagatgacatgaatctgaataaggccgtgccttagcaacagtgagagaggaagagagagactgaagagaaaaggaacaattcaagagagtgtaacaagatgataacctgggagtaagtctgtggagagtagaggattccaggacaacggccatgcatctggcttcagtggctgagtgcatggcgaagccttccggtgagatggggaatgtagaaaggtgtttaggaaagggacgttcgcttttggacatgctaatataagatgtctgcagagaatccaggtacagttacccctaggaagcgggaaatatgaaactagacccagaagacaagtgaaagtgagaagtgtcgacttggaagtcaacgccacgcaggtggaatctgaagatatgcgacagaggaaatcacccaatccaacggggcccaagaatctcaggggcaaagcggagaagtaaaggagggcacggaaacgaaaggagagtgttcccaggaggaggaaggaagggacaggtggtgtggaactcaacaatggcatcaatggggaagagactcaaaggaggtcaatggatttgaaatcaggggctcaccgatgacatcagagagagcgtgctttggggagtgataactcctattgtgggagttaagagaaaacaaacagggtcattaagtgtgcagatgactcaaggggtttcacagattaaacaggaaacaatggttagaggcaagagctgagctggaaaaagagtttgtttcttataacgggaaagtgtgggcacgtttatgccacagggaaggagtcagtggacacggaaaggcagaccccaacagatggggcagcaaggggggcgaggtccacgaggaggcagagggtagggtcaagagcacaggtggtagaagcgggtggtggggactcggctttggcaaggaggtccccatttcctctaacaggaagagacagaatgggtgcagatagagttgcatctggaagtcagcagggtgggaagttgagatgggctttatgtctgatggactctttttccctatctactgaaatcaagagacagcagaggcttaggaggatggagcagtagtgagggtctgggagtgctatagagaatgggtaaaaaggggccagctgaggacaacttggcaaggaggaagcccagctgagggaaggccagaagcagccccagcacctgtctgcaggatcctgtgactttcacagccccattgcattacaggggcctgaactgcaggaatatactgttgatgtcatcagcagttggagggttggagagggacaacgcagggatggcaggaagagggcgttgagcttgtgagtgtaaacaaacatgggttccggcagagaaagaagggaagctgcctatgctaagattttcaaaagagtaatgccccttttctccaactacagtttagcccatgaaaccaatttgtatttgtttggcctccaggaagagcagtgttatttctttaatctaggtttcatgttaacacatctgagaaccgcttgcccatctccccatttccattttcagtgcagctataatcttgataatgagggcacggtagtcattaaactattggaaactatgagtctgaaaatgcttgacagtcgcttaggttcccatttgctttatgcatttctagtctgtacaaggttcacgttctagaacaacatctgagcacactgctcacaaacagctgataagcatttcccaataggactagatgacctacctcatagggtgggcctaagggctaaatgagataatatgcaaagtgctgtgcatagcaactggctcgcagtaaccgctaaatgcacatgagctgtgctgttacagaagagatggggagtaggcagcagaacactgcgatggagacgaagagtgtaagaggacaacgctgagtaaccgaggtgatgagaaacgcttcagtgctctctgagcaacgagaaagcatggaagagacagagtcgctgcttcaagcgtgtgagaaacatcaagagatcacagaaagctactcaattcttagggtttttcctttctccccaaagaagttattcttcatcaggagagagcagaataggaatcttagaaaagttcccatctttaattccagctgaactatattccaggacagtgaaagaacttggaaaatatggtcatgaaactattcttactccactctgaagaactgagagaaagggaatggcagcagaagaccagagtggcggcaaatatggtctcaagaaaataaaaataaaactctgtaatggaagtcttcaagcaaataagtcaatgtctatctttgaccaatgcttattaagaattttaaaacatggtgtaccctagagacagcacaggtgcgttgctgtacacaccagagatagcacaggtgcgttgctgtacacaccagagatagcacaggtgcgttgctgtacacaccagagatagcacaggtgcgttgctgtacacaccagagatagcacaggtgcgttgctgtacacgccagagatagcacaggtgcgttgctgtacacgccagagatagcacaggtgcgttgctgtacacactagagatagcacagttgccatgcacaccgctgctgtctctagtgaatgctgttcttgcagctgcagcaccaagaacaaatcctgccaatctgaactcatttaattccatggagattatacaagtatatggggcaaatattattaacaccatattgttcgatttcaaccaggatttgttaatatcttcataatattctgggggtaagataaggctatctggttaggatgagaaagtatatataggttcctggctggctggctgaacaaccaactatatcttaggattaactgatgtcagccttgaatcactccttggtaggaatcattttccttattttatagatataggtgagtttcagagatggccaactgcaggccaaataacaacaacaacatttactgagggtttattgtgctaattactttaaacactgtatcttatttaatcatttcaacgaagtatcaggtaaaaaccagtccaatccttatagaagacaagactgcagctgagaaagacaggttaacctcctcaagttcaagtagctacaaagtggtggagaaggacttgaactcccagttgtataattcagaaacctgagtgctctctgctacaccacactgcctcaaatattcaagtacttgaagactggtaggtgggacaagaaacctatttgctctttattgttccaaggggcagaactaagaccctgatgtaagtggaaagaggcagcttttagttcatgagattaattaactttacaatcacagttgcccaagagtggaacattgtgctcaaaaagagtgtgctgagatcagcactaaaaaagttcacattgagtacggatacccacccagggcacacactgtccaggagatacttgccctgggtaggcgggcctctaagggcccttcccatcctgggcttataggcccctatgaaatgattcttctacatttgttcattataaaaatatacagatctccaacaggataatggggatattcatgcttttgaccagattagaaaactcacatatctaagtataccaccaaaccaacactgtgttactcaagtctggtttcatcaactctggaatgtgtgcattcttggaggaggaaagaacaccaggggcatgaactgcaagcagaaaggaatctgtcatgatgataactggaaatatatatcctgtctttccaacgggtggtttacatgtgagtttgtaggtcttggtatggggaagtaaggtaggccatactcagtattacaaagtgttggaggaagagagggcaagaatatcccttcctgatagcccattgtttaaactaccatgaaattgttttatgagtaaaagtcattttgaagcatcaggtaatagagatttttggcatgtcctatagagcttaactccatgctaggcaaataacagtatttattcacatattcacttgcgcaacacaaatttattaggcactgtattgggcactgaggacaaaatacagaacaagactgatagggtcattagtactttcctaacaagtaagcaaatacacagcaaatataaaaatgatacgtaacgtttgctagtgcaatcatggaaataaaggcattgcagaaaataatgaggagagcagcacctgattttcatagggtagtcaaggatctctccccaaggaggtaaggttgaagccacgagctgaagaatgatgatgagctaggcaagcacaaagctacaggaagatgattttggacagagggaagccaagtgcaaaggccccaggacaagaaagagctcggcatattccagccgtgagcctgagccgagactggtagggtgaacaggagccaggccgcacaggggcctgctggtcttgttggggaagctggatctcccctccaagaaagtgggaagttgctcaagagctaccttctgaaaacattctctggcttttgcgagaaaactaaattccaagacaacagggtggaaacaggcagaccgcttagggaggctcttgcagtagtgtaaacaacagagaagggtgctgaagaaacactcacaggattatacatgttgctggaaggggagagaggcaagaagtgacaactgacctctgtcaatcgtgaggtcttgacttaacctcattctggcacgctgcttgggaaacactagctaggtttattaacccaactgtggttgccaccaacagcagctgctaaaccttcttctggttttcaacaaaaatcccccatatatcttatgtattcgcagctccctaagtcatcaaaccttcatctcatctgaaaagagagcctatctgtggcttgaatcactacaatgagccaaaaatcaatttataattttgggtaatagttctaaatctattttcaatcatgtgggggtgaggggtgttgagaggaaaaagtgaatgaagtttgagaaactagcaatgaagtctctcagtcaacaatttaatgactacaaaataaataaataaatgcactagtgtacccttgggtcccagttcttattcagttacacatctgttctgcaatagaatgagggagttaattacttttctatgacatgtatgtattttgtgagacaccacattgcaccagttaataatgatctaccttctgttgacacaaaacgtttaaattaataaaaaaatctaaatgatatatcacatagcaaagcatacttcactgaaaggctggatggcaggagtagtaattttcctgggtagaaataattgagatgagcttatggtagcatgaaaagctcaatcaataaagagacttatatgggcaaactgttttcaagagtacactctttttagaaagggtaggctgtgcttcgctaatagctaatgtagcagcactgtgattgttagagaaagaaactgagactgatacccagtaattgcccataattgacaatattagcaattttccatttgaatctgtctgttcaatctttagggtcagaaaagacaaatgtgaaaagggtaaaaacaatcccttgaagctctattaatactaaaaaaaatctttgtgctcttcactgagtgtacccttgtaactagatactaaaccaactgcattatggaaacagcctattttttccaaactgtataagcaatattaaatgaccttggaaaaatcgagataatatgtaaagtagactcccagcacaaagacggaagacatactctaaataaacttgacaagagtgccttgttcaagtctcaaaaccacccaaggaaaagtctgaaacccacaacatcccgtaattattttgctattttccacttattttgggttaaaaaacaaaagtctaccacttttctttcatttttaaattcattctcacttctttcttaaaaactaggggaaaaaaaccccaaaacatcaggactggagtcaagaagtttatttcctgtataataatttctttcttttggggtcccaacgctaaaagactattacttctttctgaccattcaagcccctgctcttcactgtccttcatggtttaaagcagcctttacccatgctggcccacagagtatcatgaaaggtccatggacctgacactgtaagaatttaggtacaaatctagcgagatgaatccttttctaattcttgcctatttttggcttttcagggagcttcatatactaggaacttcttctaggctattgagtacatagtaggtatttagtaaatgctggttgtcgtgggaagcaacagataaaggtgaaaatggccaaaacccagagtgggtgatgtaaaaaagaaaaattgtccaattttataaagtttcatgattttttttcctttagcggtaggatgtctaatatttctatttaatctcaaatattaaatttatacagggatatccaggtcagaggattccagaacttgaggattaggaagctttttagcaatgcagagatcagacagatgaaaaagactgttcttagaagacctgtacaaaacaaatgccaccatatcttcttaaaaaagcccaaaaggtcagtacatcgaatccaaatacctatagctgaagtctatttctcccaatcttagtgaggactgaaaactataggtctccctgaccatgatgcagcatggttgtctggggtaaatacccgaggttcattgtctcatgccagggtaatcgaggatgcagacacacaaagtgattttgagaacggaggtttaatgggcaaaagaaagagaaaagagaataagctctctcttctgcagggacagagaggaaccggagtggtccttccggttttgtggtgaaatgcatgggggtttttatagacaagcttgaggaggcagtgtctgatttacatagggcctgagagattgggtggaccaggtgtgatgtttgcatagcacctgaagaagctggccatcccaccctaatcttttattatgcaggtatctatctgggaggtagccatgttgtctgttccttactgtacacgtgattgacaaaagggaagatggtgccactgagaggtaaagccagcaggactttctgggttgagtggggacttggagaacttttctgtctagctagaggattgtaaatgcaccaatcagcactctgtaaaaacgcaccaatcagcgctctgtgtctagctaaaggattgtaaacggaccaatcagcactctgtaaaatggcccaatcagctctctgtaaaatggcccaatcagcaggatgtgggcagggccaaataagggaataaaagctagccacctgagccaacagcggcaacccactcgggtccccttccacgctgtggaagctttgttcttttgctcttcacaataaatcttgctgctgctcactctttgggtctgcactacctttatgagctgtaacactcaatgcgaaggtctgcggcttcactcctgaagtcagcgagaccacacacccactgggaagaacaaacaactctgtacacgccacctttaagagctgtaacattcactgtgaaggtctgcggcttcactcctgaagtcagcaagaccatgaacccaccggaaggaagaaactctggacacatctgaacatctgaaggaataaactccagacacaccatctttaagaactgtaacactcaccatgagggtctgcagcttcattcttgaagtcagtgagaccaagaacccaccggaaggaaccaattccggacacaccaccatgttgaacatgcctggcccccaggtagccttttcttattggcacagctgccagcattcacccctgcaagcttccagcttgcttgtctatgtctgtgactcgattttacaggctgttctttgttagaaaagatgtgatttggggactgcttttcattaaagggaaaaccttaccgaggacttccttaccctcactatctgcccaactaatttctttttaactcctatatcaaccagataaggcccctcctttctcctgcaggctgaagagtttgtatgcccttagtctttctttaaagtcttacttttctacagtgtttctctattagaggttctctctgtccctttttaagttatggggccactatatagttatggggcagctgcataaaaacgttcatggtcttttcttgagctaaaagacaattacataaaattaaggaggttagtatccacaatttttacaatgattttaactgaccttattcataacatgaagtagttgtaaaaagtagatattcatttaatatgatgtcaaactaaggtaattttcctcatcctctgaggctgcttgttactcccattggagtactcacccatgttgaacgcaacctaattgttcagaaataattaacatgtttttatttcagttgtagaaaacataatttattaattggctgctactttatgtgttccattttaaaaggcacaataaataagaaattagcataagaaggtattgaaaaaatgccaagattgactaaattctgagaaaagcaagataattccaaattaaggatgagtaaatttattacataaaggagtttaatgacaaatgtggagacaactgttttatgggcctttagctacagctttccaattttaatgttatagacaggaaaacattatcaacgctttcataattccaggattctaatttacatatcaaaacaagagaaagagaaagcccacatctctccttacttattagagttctcggggtctgaaaacggcttgtcaacaaaggttgaaagaagaggaagcagaagatatgctgatggctgcaactgaagcaatacaatatcctaattactgggaagtacagctagtttagagaccatcacaccctcacctcagcaattaatacccagtacaattggtaaatgttctaatctttaatagaagcacccagaaacagcctgtaagcagatgagtatttgaaacaaaccgtttgccatatccccgggtattaatcgaacccaaaagcatctcattctttgtgggggaggaagaaagctgccatcatagatatgcataagcagctctctacaagctcttcttctgggtgtaatgatgtgaaaaccatgctaatttccttgcccgatatttgaattttttattcttcatgcaatcatttctgacttcttggttctacacacactcacgtttttctggctattgcgggtcgaaaggccaacctcactgttctaacaatgacttcccatccctccatgatgaaaatgcaaaccctctgcccagcataggccatccctcaccacccactgctggccttaccagcctttatcctccagcaatactaaaccattagctgttccctgatgcgccatattctctcaagcctctgggacatttcacagggtgtgtccctgtcagaagcatgtgaaccagagcaactccatcttgaataggggcctggtaaaatgaggctaagacctactgggtggcattcccagatggttaaggcattctaagtcacaggatgagataggaagttaccacaagtaacaggtcataaagaccttgctgataaaacaggttgcagtaaaggagctggccaaatcctaccaaaaccgagatggccatgagagtgacctctagtcatcctcactgctatactcccaccagcaccatgacagtttacaaatgccatggcaacgtcaggaagttaccctatatggtctaaaaaggggaggcatgaataatccacccctcgtttagcatatcatcaagaaataaccataaaaatgggtaacccgcagcccttggggctgctgtgtgtggaggagtcattctttattcctccaccttcttaataaacttgctttcactttttggactcgccctgaattctttcttgtgtgagatccaagaaccttctcttggggtctggattgggaccccttttccagtaacatccccagactgaatctctttgaaaccatctcaatgaaaattcctatacaacctgtacatctcaggtcaatgtctcctgtgaagtctttctagactgaccagggattttttttctctttcattgccactatacttcaaacaggcttccagtaaaatcactgccacaccaaattaaactgtgtctgggtatctatctccacattagaatggaagccacctacaggaaggggacatctttcaatctcaggattcccatggttggcctatgatatatgtctcacatcatgaaatacttgaggaagaaagaaagggacaaaaggagagaaacagggagggagggagagattcaagcaggtttgctgaaagactggagatgaaaatggtaattatgggtgagtaataagcaaaaaaaaggagacttaagtctatttaagccctaagcaatataagacgccttatttccagagagttaatgttcaagctataaacagaaaagacttattcctaattctagtccttgttggggtgagtcagggctccctggactctccacagcagctaatgcttcagtctcttcttacatgatagacctgtcatggagtctcacccaagtgggttgtaaaagcactggccaatgtcagtctagggtcttaaatggacacttaaatatactaaattattcagtagtaaagccaacccaaaatatctatttttcctgtttatatttctagaattctaccatctaaagggcttgagaaattggacaaagatagtatgttaagtatttgaaaatgaatacataaatggaagtgatctctcaagaaaaataatgtaaataaataaataggcctaaaagttccctcttgatgttattttacctttatttaccttttaaccttgcttccacaaccaagggcagtacccacagtgctttatcaaaagagcactgccccagaattatgatacttgtattttctgggccggattgtccagcgtcactctatttgtgagtgacacaagtcatttctcctctctgcaaaatgctgatattgacctagatgcctaatgtttcttctagctattcaaatttaactgactttctgacaaaccacttagcttgtgtgatattcgatggatctaagtacaaagtatgctctctcacgtctaccttttaagctctgaaggtatgcaatcaataacatgcagaaagagcccaatctgagtgtcatttcagcaggttttaaagacagagtgaagaaatgcatgtgttctacatcaaccatgtctacctgaagcccaacagcaacttctcagagcagggaaagagaaagtggaaccacatttggtcacctaccatccctaatacacggagctgcattacatactccctgtagcttaccaatgccaccaattccccagcttcattcttccaaggatgcaatgtcactagagggcgcagttaatgactatataaatagtgagccccaagatagttattgtgaaatttaacctctttccatatcccaacagtgagctgttagtggaactttgtgtggcagagacctatagaactccaaagttaggtaaggtcaaacatgtcatgttttaaaggctttgagcatgtactatggaccaaaagcataagccttcaagttcactgttgagcccgattaacagataaggggaaaatgtactttttgagaaaaataaataggttatttttgcatggcaccatgttctcttaatttctatagagagtgagataacagaagtgactagaatacctttttctccttctaggacatccttcccattgacactggaggggccaactacatgttttaatcagagcccacagctgcccacacccactgcagagtgagctactctccaccaaccctgcagccctgaagtttctgtgaccactgaagaggtctgttttcagacttagggtcaaagtgtgggtgacctccaacacctactgtaatgaaggaataaatgtcaatagaagccttgtctggtctctgtcccaaggcattttattatttgtttcattgtgagattccaaatgtggtcttactcagaaaagaacaataattcttacatggcaaattctgaaagaggcatcaatgcaatccctctcaaaataccaatgacattcttcacagaaacagaaaaactaatccccaaatttatatggaaccacaaaaggtccagaatagccaaagccattctgagcaaaaagaacaaaactgaaggaatcacattacctgacttcaaattatactacagagctatagtaaccaaaacagcatggtactggcataaaaacagacacacagaccaatggaaagaaatagagaatccagaattaaatccatacatctgcagtgaactcatttttgacaaaggtgccaagaacatacactgggggaaggatagtcttcaataaatggtgccgggaaaactggatgtgcagaagaatgaaactagatttctatctctcactatataaaacaattaaccaagatggattaacgacttaaatttaagaccctcaaactacgaaactactaaaagaaaacactggggaaactctccaggacattggtgtgggcaaagatttcttgagtaacatcccaaaagcacaggcaaccaaaacaaaaatggacaaatgggatcacatcaagttaaaagcttctacacagcaaagaaaacaatgaacaaagtaaagagacaacccacagaatgggtgaaaatatctgcaaactacccatctgacaaggaatcaataactaggatatatataaggacttcaaacaactgaataaggaaaaaaatctaacaatctaacaatctgggcaaaagatctaaataaacatttctcaaaagacgacatacaaatggtgaacaggtataagaacatcccgcatcatcaaagaaatgcaaatcaaaactacaatgagatatcatctcaccacagttaaaatggctttgatccaaaagatagggagtaacatatgctgacaaagatgtggaaaaaaagggaaccctcgcacactattgttgggaatgtaaattagtacatctactatggaaaactgtatgaagggtcctcgaaaaactaaaatagaactaccattgatccagcaatctcactggtaggtatatacgcaaatgaaaggaaatcagtatatcgaagaggtatctgcacgcccatgtttattgcactactattcacaatagctaagctttggaagcaacctgagtgtctgttgatagatgaataaagaaaacatggtacatatacacaatggagtactagtcagccataaacaagaatgagatcctatcacttgcaacagcaaggatggaatgggaggacattgtgttcaattaaactagccagacacagaaagaccaacttcacatgttctcactaatttgtaggagctaaaaattaaaagaatttaactcatggagatagagagtagaatgatggttaccagagcctgggaaggtagtgggcaagggagggaacgggggatggttaatgggtacaaaaatataatcagatagaatgaataacatctactatttgatacaacagggtgaccagagtctacaataatttactgtacatttaaaaattactgaagaaatataattggaatatttgtaccacaaaagaaatgataaatgcttgaggcaatggataccccatttatcctaacatgattattacacattgtatgacagtatcaaaatatttatctcatgtacccataaatatacacgcctactctgtagccataaacattcaaaatttaaaaatacaaaaataaataatgtttacaaaagaggattggtctcttgggaaataaactgcagagacagcccaggatgacatccactttgtccaggaatctggggggaggggagcaatgacctggatgtgactctgtgcagtgccactcatgctgtcttcttactcagctgtacttcccttccttctgctatgtacaccccctcagtgacagcaatgtcgggaactgtaggggtgaagaggacagcacgagtagtgatgaaggacagtgatatgccccctaagtctggacaaaggtcagcttacttctggaaggagagcccaggttaggaagtgcaggggagcaagccaggaagaatacaagaatgaaaaacaagctgagctgagcatggtggctcacacctgtaatcccaacagtttgggaggcagaggcaggaggactgcttgatcccagaagctgaagactagcctgggcaatacagtgagactccatctctacaaaaatatttttaaaaattagcagggcatggtggcacacgcctgtagccccagctactgaggaggctgacatgggaggattgcctgagcccaggagtgagccatgaacacaccactgcacttcagcctgggcgaaagagtgacgccctgtctcaaaacagaaaaaagaaagaaagaaaaacaccaaccaccccagcacagtgaccactggaaccaaaccaaacaagaggcactaggcacaaaaaaagggggaagaaagcagagacaactaaaaattggaacaggaggagttaaaaaactgttaagaaaattatgtgaacaattcagagactctgatcagcaaatgatgggaactgaggatgctgtatttcttggaacctcccaaatagactatttccccagatcattcaataataataatggctaccattaccaagcatctaccatctcccaatctatacatatattatctaattatctaattgaacccttaaagtagctttgccaggtttagagtattctcattttacaaaagagaaaattaagaccatcacagggaaggtaacttgctgatgtcaaagggttggtcaacagcagaaaccagaaccatctatctgcaaagcacatgctctttccaccgtatcaagctgtcctcttatccaccatttggatttcatgtctctggccagttgctgatgctccggaactagaacccaacttctgctaaatctaactctgtactctttgtataatatcctgtggctttaaataagatattgactcagcaaatggtactagaatcattggctatccatatacaaaaaagaacattatgcatacacataaattaactgaaaatggatcaaattcctaaatgtaaaacctaaaactataaaatctaatatgaaacacagaagaaatatctttctcctcttgaattaggtaaagattttcagctatggcttcaaaagactgatccatgaaagaaaaatactgataaactaaactatttcaaaatttaaaacttctgcttttcattctgtgaagagaatgaaaagaccagctgcaaactgaggaaaaaaacatgtataaaacatatgtccaacaaaagacctgtgtacaggataaagaactctcaaaactcagtaagaaaacacccaatttttaaaataggcaaaagatttgaacagatatatcaacaattaagatgtacatgtggcacacaaacacgtgagaaaacacattacagtactgcaaattaaaaccacaatgcaatgttaccacactaaatgtattaggaggatgaaaaacaaaaagaaaatctgacaaaaacaagtgctggtgaggatttggggtaactggaactctgagtcattgctggtgggaattcaaaacaataggggctgctttgaaaaaaagtgcagcaatttcttataaagttaaacatatatttaccatagagcccagcaaccccactcctaggtatttgtccaaataaaatgaaaacttatatttgcacaataacctgtatgtgaatgttcacagtggctttgacaaccaccaaaactagaaaacaactcaaatatccttcacttagaaaaacaaactatgaaatagccatgtaatggaatactacttggcaataaaaatgaaccaactattgaggttatatattataaatgtgtgtacaaataacatggctaagcaaaagaagccaaatgaaatggctggttaatgtatatgatattgtggaaaaggtaaaatggtagtgacagaaagaagatttgggttagcaggtgctgggagtggggtatagacatggatacaacgcagtacgaaggaatttgggagtggtggtgatagaacgcttctctatcttgatggtggtggtggtggttgtggtcacagactgcatttatccaagtttgtagaactgtacactaaaaagggtgaattttactgaatgcaaattacactccaattctttaaaaagatagggaaggtctatctgttactcttatcactatagaaacagcatagtgaagaggttagggctatactcttgaaagctcccgttgcctcatctgtaaaacggcagtaagagtaaccctaactttgatatggttgtagagagaaatgagatgaggcatacagagaagtctgcagagtacctcgtgagaggtgaagccagctggacttccagggtggagtggggaattggagaacttttctgtcttacaaggggattgtaaaatgcaccagctggtgctctgtagctagctagacgtttgtaaaatgcaccaatcagtgctctgtaaaaacgcaccaatcagcgctctgtagctagctagaggtttgtaaaatggaccaatcagcaccctgtaaaatggaccaatcagcaccctgtaaaatgaacctatcagcactctgtaaaatgaacctatcagcactctgtaaaaggaaccaatcagcaggacatgggtggggacaaataagggaataaaacctggccaccccaaccagcagcggaaacccgctcaggtccccttccacgccgtggaagcttttgttttttcactcttcacaatacatcctgctgctgcttactctttgggtccgtgccatctttaagagctctaacactcaccgcaaaggtccgcggctccattcttcaagtcatcaagaccatgaacccaccggaaggaaccaactctggacacactagcacacaataagtgcccccataagctttagcaggtattctaatttccagtagtatctgaggaagaatcaccttattgtactagacttcctgaacactactgcgtacctgtggaccatgtgttgggctggggatggtacttggtacacaagaacacatactctgtatcacattagctgccatccctcaatctatcctctgagctggaggcttatgaagccccaaagatggtagaaaagaatgtgtgtgcaagaactggaaaggtgagacagaattcacgacaccacaaattgtggagagaccatcttttacccgaggtggacataacagggccacgtgaaggagcctggtgagcacagctgcctgtcctctggggagaaggcagagaagaagtgccacatcctgtgatgtggtgaacgccacagtccaaggcaaacacaatagctacattgtttatctctcagccaactttacagcccatcgtagcatgcccagaagcctctccccgtatgtcatagcaacactgcagacgggattatgtgattatgaagtcagtaactcccttccttgattaaacatgaactcaaacagacagtcattcactctgggggaaacccatttttctgcttgtctggagaagcaagacacaggtaacatacagcaatgttaggtttcaactaattaaaaatgggaatgaacacacgcacacgcacgcacacacttcttcagttccctgtcaaatcttcctgaggacaacatagtttggttatgatgaaaactttagaaacgggaaacattctgcttagattgttaaaattgagaacaacgcagagctggttgggctcatcatcccaccaggagacagttctgcttacaatttatctagcaaaatagagtaaggcagcagaaaaaatcttggtttcctagtgacctttaagtaagtgctcccatttcaaatagactcagtaccataaaaactttcttgggctgagaactttcatttcctttgaatataacttttgcgctaacattctttcatttcttcttcttcagacaatcattgtttcttcctttcactcaaacctgcctctgttccccggttttcacggtttacagggcatagcccaggtgatgtacagcccacatgggaatcaaggcagttcccacacagcaccagcacaaagtcatttctttgtagaagctgggcttcttcagggctgtgtaactcataggtgtcgtggagggtctcagaaggaaacgagggaaggcaattctgtgttgcagaaaaagagtttttctaaaaagaagctgaaataattaccagagacaaaaattaacattgctttatatttacagaagaaactaagaggaagtaggcttagaattgtagcatcagggaatgagaagtttattaaggcttctccccactacagaaccatttattaaactgtttccagaatggatacattttcacaatgatcctactcaatctctcttcatagaaggctctgtgataaaagaagatatagatcccctgctccacagacggctgacactgggtaaaagatgcacacatacttggaagccctcaggaaaattagatcattatcttctcgttttttctttgcctccaaagacttagatttttacctatgtactcgaaaagcaactgcagacttccaatcaagatgctgtaagttcaaacctggaagcgttcccttctactccaaatccatagtaatgacaggtaaaatataaaaacaggaaccaaaaatagctttgccaagtcaaaaaaaaaaaaaaaaacaggcaatgatctccctggaccaaaaatagaacagaaatgcaaagcaataaacaaagctgaagctccagggcctgaggtctggaagtaggtggcagtaggtacaagctgagtgctggtggttaaacagggaatacaaatgtttcacataaaaatggtgagtacagtcaaccttaaagcttaaagccagagaatggggtgaggctaccttgcttgacaaaagaggccgggataaacaaaaccagggctgatgacctgttcccctgtgctagatatttacaggaagctgtgggcctgaaggggccaaacagagccatgctctcttgtctaggtacacagccatgacgcccaccatctaggcaacacttctgcactagcctcagcatcaccggggcgcaagaggtccaaatgccattaagttctggttttgaactggaggctgaggggcttgggggaggcaaaactaccagacagaagggaagagcacagaaggagtgaaaagaacaaaacaaaaaaactgtccactaaaaatgagcctgccatacaaaattccagaacactgagtgaaatgcaatgctaaccaactgaaaacaatcagaacataaattccctccagtaaaataaacttcatggaactaacacttaaaagaagtgtgattagaatacccaaagagatgaataatgtagtagcatgcattaaagtaaaaaagaagttataaaaccaaaataggcagaaataaaacacagagacgtgaaaaagaacaaatttgaaatcttggaaataaaaattggtctttaagctgaaccagtaagcagaaagtatccctagcacctgacttaagggagctctaagtttaaaaacacggacaaaatgccagaagctaaaatgggttctctctgaggagtaggtcgtgggcaggagcaagagaggaaaggggtaccattgttttcaactgtgttagagtactttaatttttcaaactatatacatgtattactttaataaaaaatcaaaataagaaatgtaaaagcccatttgcaagaaataacactagtgaaggattacctgaaggatttgcagtcactgctttcctccatagagactaaattgtattcttggaaagaaacaaaccatcaaagagatatgatcttagattacctaatttttcacgcttctagttacctcttttattaagaagtattaatttggctgggcacggtggttcacacctgtaatcccagcactttgggaggccagggcgggtggatcacttgaggtcaggagttcgagaccagcctggccaacatgttgaaaccccatctctaccaaaaagtataaaaaattagccaggtgtggtggtgcgcggcgcctgtaatcccagctattcagggggcaaggcaggagaattactgaaacctgggaggcagaggttgcagtgagctgagattgtgccactgcactgcagcctagaagacacagtgagactgtctccaaaaaaaaaaaaagtattgtcaatcagctatgatgaagaatattatagaaatcagtgatttcactcgctgtggaagtccagtaagaatgctttgtgagtgcctcaggcctcagtgcagggaaaaactgctctggctgtgttttccttcttagggctactgtgaattttgaaagtagtcttttaggtttggctgctgatacattaagggtaaattcatcatttttctagctgttatatattgcttctaggccttttggttaagctcaagtgtagtacttctagctgttacataaaggatcatatggtataaattctgcatactaaactactttcatcttatttgtcacttttatttctcaaacgaaaataaaatttattgctgttgtattacatatgcaagtagatacatatatacatgtgtatgtatccttgtgaatgtgtgcgtgtaagctacttcaaaatcttttgggtggaggaaagggaacaattagataaaggaaattggtattttgaaacagaaaaagggaacaaaagcaggttgaatgttagggtcgcaactagagagcactgaatggcaacctatgagtatgaagttgatcctgagtgctaaagataatgctgaatgcttgaacatttctgagcaaagtaacaacatgagaatagtggcatctgagagagtttacctaaaacagtgtgtgccaaggatgaaaagaaagaaattgagagcccggtgaataatcaggggctatttcaataacctagcagtgaggcaacagagctttgatagactgatagacatggtgtttcaaaagaattaactctaacaggacttaggaaagaaaaattgacatggcaagtaatcatagcttgtttgttttttgcaacaaggcatgtgacatccaaagcagcacgctatgttcttgccacaaacttatggaaacaatcaattccatttggtctgttcagctcctattgccttggattctgacctgggcaagccatgaggacccaaatcattcaaaaacctccctcagaaggtaagttttatttttttccagaaattaagctgcagctgattacaaatgacaactgtaaatatgcaaattatacttgctattaaaagggttcctgccttcctgaaacaaaatactgtgtaagtccaataatatgcagatgtagacacataataaatattgcttgatgcagaaaactggtgagatgaattttctaggttccaagaaaagcagaaaaataagcttggaaactttaaatccaggaactgaaaattaattttgattgaactaatgttgaatttatgatcttttgggaatgcactaagctgaatttacctctgtatttttttttgaggcaaattgatagtacagagatctcagaggagtgtttatatcactaaacaaaattctcaaatagaaacttaaaaatacaactgaaaaattagttgcaaactaagtttatattctcatctaagtacatactctactctcttccactagaaaatatttcatggaaacatgggaaaacaggagcggggaggggccctatggctgtctagtgtaattctttaatgttacagaggatggaacgaatccagagaggttcaatgacttgcccaggaccattcaatgtgttagatacagcatggactataatccagcagagtaatcaagtactgttttcatgacaccattagacccatctcaatattttaatggtcaatgttatatgttaacttgagtgggccacagggtgcccagatatttggtcaaacattattcatagagtgtctgtgagagtatttctttatgagcttgccattggaatccacagactcagtaaaggagtctgctctctctggtggcacttaactaaccagctgaaggcctgagtggaaccaaaaggctgcaattccctcaagtaaaagcaaaagagaattcctcctggcttactgcttgagttggactgatcagttcttcttggaacttgggcctgccagcttttggaacagaacttacaccactggctctcctggttctcagggcttcagacttgtcctgaaactataccatggctcttctgggtctccagcttgccaactgcagatcttgagacttctcaacctccataatcaggtgagacaattccttagaataaatctgtttctccaccccatcttgttggttctccttctctgaaaaaccctaattttaatattaaacgaatctttagctcaatagagtaaagaaaatggtctcagtgggtatggtagacattatgcactagctacccaaaatccatttaacacctctcttttctcttgacttcctcttgcataaaggctaaaaagctaaaatacagttcctagcctcttctatagctaaaggtggccatatgacaccattctgaacaacaaagtaaatgacatcatttttgagcaataaagtgtaggtagatatccttaggaggtcttccctttgctctttgcctcttattaccccatcttttttctccagagcttagatacactgactggggtttggaagcatcagtcatcttcagactgtaaggacaaacccacatgctagggatgactatggaggaagacagaaggatttcaggtccatgatgagatctatgagtcgctgctgtcatcttggattacttctccagaatttttagaacatgcaccccacctactaaagctacgtttagttgggctatctgttatttatagccaaatcctttcctaatatactattgcagcccagatgtcacctgttacaataaaactaagatcactatgacccccattttaataaaagatcatcattcattcactcaagaattttctgaagatccaccatattcatggcacctaagaggaactaaattcaagagccttctcatttccaaccaaggatgctggtggaaagctaccttgctaacattccagatcatggtctgggaggaatcccagggcagtttcccatgatttctgtcattcttgcctgtggcaaaaggctaacaataaagtagattgaatcttcaggagctattagaatattcaacttttcccacttaattcccttattttcaaaagttcttcttaaggcaaaatggatcatgttcatggactcctgcagcattagaatgagctcagggtcctttctcatgcagtgagagcaactacctctcttgattcatgttgccaatgggagttacagtgagttgtggtatactggcaggagcattaggtttagtcatgacatctgggtgtcagacttggttttgccactttttcctttaagtcccaggggtaagtcctgggataagtctcagaggcatatctctgaacctttccgagtttcacttcctaatttacttataattactcagaccaagaaagataacaattacgaaagaattctagtgaggtaaacattcttccaaagtaagatttctttagacaatctgattatgtgaaatatttcatattggacctaaaaataagtaggtccaacatgaaaaaggtatatgagtaacagaagaaaagtccattcattatcttcatggcatttactttgtctctcctttctcagagtaaaagttgttacataagtgatctcaatctaataatgtgctgcagtggaaaagccttatggagcaaatgttaaagaaacagagagacatcatcaagatggctgactagaggcagctggcactcatctcctccaccaaaaagaaggaaaacagtcagcagataaccacaggttaaacagagcatctaagagggaacaatggaattcagcacaaaagggacagggactctccaaggcacagagaaagagggaagataagcagcagtctcagccgggattggctcagagccaggaaaggctccccattgtagggaaaaggtaagcaagaaatctccagttgtccacattaccaccacagatgcctgccatcctagccacaggagagctgctcagcttcacaggccctgagcctagtatagggagttgactggagtccatcatggaattgttcccaagggcattcatgctgcattctagtcacccctcaggacccaaggtgctgtggcatggcaccattttaagagcccagcaacaaccagactatatcctgccctggaccccagaagcccctccattccacatccctggaatgccactgatattcccccatatccactcagagggctgcagtatcatgaggccagctggaccaagtggtacagccagatatccagtactctagcccacactgtgtcctataccctggggaccagcagaaccagtgcaccagggaggctgcccccatgacaaatggagctgaagcacattttcctcaaagcatgggagctgcctgcctggggccactgccacctacagcgatgccaccccttccaaggacaaggccaccacacacctgtacatgccttcaggggacctgagaaccagctctctggggcacaatgtccagaggccccatctgtatcctatctgggggctggaagataggataagcctgcacatggcatcaaggaaattgaggacaggcctgggtcaacccatctccagtggtgccatatgcaccattacaaggcctgcagacagtctcatgtcatttagacacctaaggaccagaatgcctggcccactgccaccatcaccagtacctacatgtgccaacaaggggcctaagaaccagcccacctggtgtctccatccccagcaaaggttgcccaagcctccactaacaatcacagcctaagccactaaagaacctgtgatcactgctgacactgattatggacaaagaaataatatgaagaccacagtactgttcctacccaaaatcagagctaaagaactctacccaacaaatactgtaaatatatctacatgaaaaagtcattctctatgaaagccaatccaaaaacttagaagaagcaattatgacaccagatgcacagacgtaaggacacgagaaatgcgaaaaagaaaacatgacacctacaaagcaacacaataattcttcagaaaaagatatcaaagaaaaggaaatctatgatatgcttgaaacgaaatgcaaaataatgacctcaaggaaactcagtgatatacaagagaacacaggtaaaacaatatgaaaaactcagaaaagcagttaatgatctgaataaattcaaagagatatcgtaaaaagaaccaaagagaaatcctaagactgaagaattcaatgaacaaaattaaaaaatataatcgagaagcttcaacaataggctagatcatgaagaaggaatttctgaattgaaggcagagcttttgaaataacacagtccaaaaaaggtgaaaatctaacaaaaaagaatgaagaaagcctaagtgacatatcggacatcataaagtaaaaagtattcaaataccgaaatttccaaaaggagaagaaattataaaagtcagagaaaacaggcagagcaagatgctggaatagaaagcttcaccaattgcccccacccccacaaggacaccaagttaacaactatccacacagaaaaaaacaccttcatgagaaccaaacgccagatgagcattcacagtactggcttttaacttcctattgcgaaaaggggcactgaagacatagaacaaactgtcctgaatcgccagtgccacctctccctgacccccagcagtggtgcgtggtgacaagagcatctctgggtgctagggaagggatgatatagtttggctccgtgtccttacccaaatctcatctggaattgtaactggggcttgcatcccctgaaataacagcctgagctgtaccttggcctcttttacccacagctggagcaggtgggatgccccaagtcccgaggctgcacactgcaggggggccctggaccctgcccataaaaccattttttacctcctaggcctctgggcctgtgatgggaggggctgctgtgaaagtctctgagatgccctagagacattttccccgctgtcttggtgattaacatttggctccttgtttcttatgcaaatttctgtagccagcttgaatttctccccagaatatgggtttttcttttctaccacatcgtcaggctgcaaatgttgactccatgtctcacatccaggtcatgtggggattatgggaagtacatcttgaattgtaatccccataattctcacaggtcaagggaagaacctggtgggaggtgattggatcatgggggctgttttcctgagacgggggtgagttctcatgagatctcatggttttataaggtgctcttcctgctttgctcttcgttttctctctcatctgccaccatgtaagacatgcctcttcctcttcactatgattttaagtttcctgaggcctccctaaccatgtggaactgtgagacaattaaaactctcttctttgtaaattacccagtctcaggtaatatcttcatagcagtgtgaaaacagactcatacaaggaagaatacagcaattgtgaggcactgaactcagtgctgtcctgttagaggagaaaggaaaagcaaaccaaactcacctgatgttgcccacagagggagcatttaaactagccctagccagggggcaatctccaatcccagaggtccgaacttgagtgcctgcaaacctcaccactgagggccaaagtactgttggcctctaagtaaacctgaaaggcagtctaggccataacgactgcaactcgtaggcaagtcctacagctgaactaggcccagagacagtggacttagggggcatgcgacatactgaggcaccagctgggacagccgagagagtgctggcgtcacccctcccctggccccagggtgcacagcacctggctccaaaagagaccccttccttctgcttgaggagaggacagggaagagtagggaggactttgtcctgcatcttggataccagctcagccacagcaggagagggcaccagcagagtcgtgaggcccccattccagaccgtagctcccagatgacatttctagacatactctgagccggaagggaagccgctgccttgaaggaaacaacccagtcctgccagcattcatcacctactaactgaagaacccttgggccccgaataaccagcagtgacacccatgaattacatcgaaggccttgggtgagtctccgggacttgctggcttcaggtgagactcagcacataaccagctgtggtagctacagggcaaaactccttctgtttgagaaaagcagagagaaaaataaaagggactcaactaccaacatcttaggtaccaagaaccccaagaatgggttcctggggtccctgactccaagacttgagtcttagcatttctgggcctgccttcggccggagggcagtcctctcccctgactagagtcccaaatccctgcaacattcaccacgagctgactttagagaccttgggccttaagggaatgttggcagtaatctggcaatactccatgtggccaggggtaaaggtggctgcggggtgaggctcctgtgcctttggaaaaaggagggaagactgagaaagattgagtcttacagttttagtgccagctcagtcgtaatacaaaagaataccaggtagacttttaaggtctgactcccagacagtacttctggacccacctggggcctgggggacctcatggccctgaagggaagggcataggccttgctggctttgccacctgctgattgtagagccccagacccttgagcaaacacagtcagcagccagggagtggttacagcaggtcttgggcgagacccagcactgtgctggcttcaggtctacataaaagcagaaacatggaacaatggaacacaacagaaaacccagaaacaaatatacacacctatggtgaactaatttttgataaaagtgccaagaacatagaaaagacagtctcttcaataaatgatgctgggaaaactggatagccatatgcaaaagaatgaaactacaccactatctctcaccatatacaaaaataaaatcaaatggattaaagacttaaatctaagacctcaaactataaaactactacaagaaaatattaaggaaaatctccaggacactgggctgggcaaagatattttgagcaataccctataaacacaggcaaccaaagaaaacatggacaaatgggatcacatcaagttaaaaagcttctgcatagcagaggaaacaatcagcaaagcgaagagacaacccatggaatgggagaaaatatttgcaagctacccatctgacaaggggttaatcaccagaatatacaaagagctcaaacaaatctatagaaaaaacaaatctaataatctgatcaaaagacggacaaaagatttgaatagacattgctcaaaagaagacatacacatggcatacagacatatgaaaaggtgttcaatatcactgtcagagaaatgcaaatcaaaaccacaatgaggtatcatctcaccccagttaaaatggcttataataaagacaagcagtaacaaatgctggtgaggatgtggagaaaagggaacccttgtacactgttgatgggaatgtaaattaatacaaccactatggagaactgtttggaggttcctcaagaaactaaaaatataactaccataggatccagcaatcctactgctgggtatatacccaaaacaaaggaaatcagcttatcgaagaggtatctgcactcctatgtttgttgcagcactgttcacaatagctaagatttggaagcaaactaaacgtccatcagcagatgaatgcataaagaaaatgtggtacatatacacaatggagtactattcagccagaaaaaaatgagatccagtcatttgtaacaacatggatggaaatgaaggttattccattaagtgaaataccagtctcagaaagacaaacatatgttcttacttatttgtggtatctaagaaaaatcacacgttcttatttatttacttatttattactaaaaaatcacatgttcttacttatttgtggtatccaaaaatcaaaccaattgaactcatggacagagagagtagaaggaggcttcccagaggctgcaaatcgtacgtggtttacaggggacgtgaggatggttaatggggacaacagaaatagaaagaatgggtaagacctactatttgatagcacaatagggtgactatagtcaatgattacctagttgtatgttttaagataacttaaaaaatgtaatcggatcgtttgtaactcaaaggataaatgcttgaggggatggataccatattttccttaacatgcttctttcacattgcatccttgtatcaaaacatctcatgtactccataaatatatgcccctactatgtacccacaaattttttaaaaaataaaataatttaaagtcagagaaaacctatttaacgaaataacagccaaaaccaaaggaattcatcaccactagactagctctaaaaaaaattcttaggagagtcctatatccagcagcaaaaggacaatatttgccatcatgaaaacacaccaaagtagagaactcactgatagaacagatacgcaaatgggaaaaagaagggaatcaaatgttatcactacagaaaaccaccaaactgtaaaggcaaacaatacaagaggaagaggagaacaaaggatttacaaaacaatcagaaaacaatttttaaaatgtcaggactaagtcctctcatataaataaccataactgtaaatggtttaaattcccccaattaaaagattggctggataggtaggaataacaacaacaaaaagaatctaactatgtgctgcctacaaaaaaaatcacttcaattgtaaagccagattaaaagtgaagggatggccaggcatggtggctcacgcctgtaatcccagcactttgggaggccgaggtgggcagatcacgaggtcaggagatcgagaccatcctggccaatatgatgaaaccctgtctctactaaaaatataaaaatcagctgggcgtggtggctcgtgcctgtaatcccagctactcaggaagctgaggccggagaatcccttgacccagggagttggaggttgcagtgagctgagatcgcgccactgcactccaacgtggtgatagagtgagactccatctcaaaaaaaaaaagtgaagggatgacaaacaatactccacgcaaacagaagccaaagctgagcaggagtagctgtagtgtatcacacaaaatagacattaagtcaaaaaacaaagagagacacaaaaggtcattaaaaatgataaaaacatcaattcagcgataggatataaccattgtaaacatatatgcgcccaaactggagcacccagatatacaagacaaatattattagggctaaatagacagagagaccccaatacactaatagttggggacttcagcagtggacagatcatctagacagaaaatctacagaaaaatatcacacttaatctgtaccacagaggaatccagcagatgtttacagaacatacatccaacacctgtagaatatactttcatctcatcagtaaatggaacattctccaagataaatgatacattagtcctctaaacaaggcttaacacatttttagaaactgagatcatatcaggtaccttttcagactgcaatgaaataaaactagaaatcagtaaaagaaactttggctgtacaaatacatgaaaattaaacatgcttcttgggtcagtgaagcaattgagaaaaagatcaaaaactttattcaaacaaatgaaaatggacatacaacatatcaaaatgtatgggttacagcaaaagtagtgttaagatggaagtttatagcaataaacacctctataaaagaggtaggaagatttcaagttaaaaagtctaacaatgtatctcaaggaactagaaaaacaagaataaaccaacatcaaaattagtagaaggtaagaaataaagatccaaacagatctaaacaaaacagagattaaagaacaatacaatacaaaagatcaatgaaacaaaaagttttttgaaaagataaacaaaattaataaacgacttgctagactaagaaagaaaaagactcaaataagtaaaatcagtgaggaaaaaggggacattataccagattccccagaaattcaaagcatgattagagactgttagcaacaactgtatgccaataaattggaaaacctagaagaaatggataaattcccagtcacacacaaactaccaaggttaaaccgtgaagaaaacagaaaacgtgaacagaacaatagcaagtaatgagatagaaacagtaataaagcctcccatcaaagaaaagcctaggacctgatggcttcactgctgaattctaccaaacatttaaaaaagaatgaataccaattctactcccactattccagaaaaattaggaggaggaaatacttccaaagtatatatataaaaccagcattatgtaaaaccagcattaccctgatgctaaaactagacaaaggcacaacaacaaaaaactaaaggccaatatcactgattagcatagacacacttttttttcaacaaaatactggcaaaccaaattcaacattaaaaagatcattcatcataatcaagtgggttcatctcagggatggaaggatggttgaacatatgtaaatcaataaaggtgatacatcacattaacagaatcaatgacaaaaccatatgatcatttcaatagatgttgaaaaaaactttcaataaaattcaatatgccttcatgatgaaaaaaatcttaacaaactgggtatgagggaaacatacttcagaaaataagggccatatatgacaaaccccaagctagcatcacacttaattgggaaaaactgaaagcccctcctttaccacgtggaacaagacaaagatgtccactttcaccacttttactcaacacagtactggaattcctagccagagcaattagacaggagaaaaaattaaagggcattcaaattagaaaggaagaattcaagttagccttgttcacagacaacatgatcttacatctagaaccaagagactccaacaaaaactgttaaactgataaattcagttaagtcgcaggatacaaaatcaacatacaaaaatcagtagcatttctatatgccaacagcaaacatctgaaaacaaataaagaaagcaatcccatttgcaacagctacaataaaatagcataaacacctaggactaaacttaataaaagtgagatctctacaataaaagtataaagcattgataaaagaaattgaagagaacataataaattggaaagatagcccatgtggattggaagaatactgctaaaatgaccgttctatccaaagcaatctacattttcaatgtaatccatatcaaaatatcaatgacactctgcacatgaaaagaaaaaggcaatccggaaattcatatggaacaacaaaagcaatcctggacaaaacgaacaaagctggaggcatcacgttacctgacttgaaaatgctctataaaattacaaaaagcaaagtaagcatggtactagcataaaaatggacatatggaccaatggaacacatgaaagaacgtagaaacaaatccacacatttagtcaatggagtttcaagaaagtcatcaagaaaatacattgagaaaggaaaatctagatagcccatatgcaaaagaataaaactagacccctatctctccccatatacaaaagtcatatcaaaacagcttaaatatttgaatataagacctaaaaccatgaaactactataagaaaacattgggtaaacacttcagacattgagctgggcaactacttattgagcaagacctcaaaagcacaggcaaccaaagcaaatatagaaacatgagatcaaatcaagctagaaagcttctgcacagcaaagaaaataatcaatgaagaaacaacctatagaattgaaaaaaaaatttgcaaagtattcattggacaagagattaataatcacaatatataggaactcaaactcaatagcaaaaaacaacccaattaagaacaggcaaaatatgctgaattcatagaaatggccaacagatatataaaaaaatgttcaataacattaatggtcagggaaatgcaaattaaaaccacaatgagctatcatctccccagttaaaatggctactataaaaaagtaagaaaataacaaatgctggcaaggatgtggagaaaggggaaggctcacacattgttggtggaatgtaaattagtacaaccactatggacaacagtaaggaggttcctcaagaaactacaaacgcaactaccatataaccaaacaatccaaacgttggatatagatccaaaagaaaggaaatcagaatatcaaagagagatctgcactcccatgtttattgctgcactattcaaaatagccaaggcaggggtcgacctaaatgtccatcaataagtaaaaaaaaaaatgccatatatatatatatacacacacatatacacacacacacaacggaatatagttcctctatgaaaagtaataaaatcctgtcatttgtagcaacatggatggaacttaaagacatcacatgatgtgaaatatgccaggcacagaaagacatatctcatgttctcactcatacatgggaactaaaaagaaggtgattttatagagatagtgaatacaatagtggttttgaggctggaaagagtagtaggtagagggattaagaggggttggttaatgcatacaagattacagctcaataggaggagtaagatctagtgttcagctgcacaatagggcaactatagttaatagtttactgtatatttcaaaatagctagaagagaaaatttagaatgttcccaacataaataaatttttgaggagatggatctcccagttacccagatctgatcattacacattgtatgctggtatcaaaataccacatataccacacaaatatgtacaactatcatatatcaataaaaatgtttaaaaagcaataaagagcatttaacttggaagaaatcacattgtcctccctttgcagacaacatgaccttatatacggagaaactaaaagactccaccaaaatacccttagaactgataaattcagtaaagctgcaagatacaaaatcaacatgcaagaatcagcagtgtttctatacaccaataatgaactacctgaaacagaaatcaagaaagtaatcccatttacactagctacccaccccccaaaaaaagacacctaggagtaaatttaaccaaggaggtgaaaggcctctgcaataagaactataaaacattgataaaagaaactgaagagaacacaaatggaaaggcataccatgctcattaattggaagaattaatattgttaaatgatgatactatccaaagcaatctacagattcaatgcaatccctattaaaataccaacgatattcttcaagaaatagaactaatgatcctaaaattaacatgaaaacacaaaagaccccaaatagccaaggcaataccgagcaaaaagaacaaagctggaggtatcacactacctaacttcaaaatatcccacaaagttatactaacaaaaaaaacatggaattggtataaaaacagacatatagaccaatggaacagaacagaaaacgcacaattaaatacacattatttataggcaactgattgtcaacaaaggcaccaagaacacacagtggggaaaggacacctcttcaattatttgtcatcagaaaagtggatatccacgtgcagaagaatgaaactaaacccttatctgtcaccacacagaaaaatcaaccaaaattaattaactactgtgagcctggaaactataatactaaaagaaaacagttggtgggactgtaaactagttcaaccattgtggaaaacagtgtggcgattcctcagggatctagaactagaaataccatttgacccagccatcccattactgggtatatacccaaaggattataagtcatgctgctataaagacacatgcacacgtatgtttattgtggcactattcacaacagcaaagacttggaaccaacccaaatgtccaacaatgatagactggattaagaaaatgtggcacatatacaccatggaatactatgcagccataaaaaaggatgagttcatgtcctttgtagggacatggatgaagctggaaaccatcattctcagcaaactatcgcaaggacaaaaaaccaaacaccacatgttctcactcataggtgggaattgaacaatgagaacacatggacacaggaaggggaacatcacacaccggggcctgttgtggtgtggggggaggggggagggatagcattaggagatatacctaatgtaaatgacaagttaatgggtgcagcacaccaacatggcacatgtatacatatgtaacaaacctgcacgttgtgcacatgtgccctagaacttaaactataatttaaaaaaaaaaaaagaaaacataggggaaacacttcagaacattggtctaggcaaagattttatggctaagaccacaaaagcacaagcaacaaaaacaaaaatagataaatgagactgtattaaaccaaaatgcttctgcagagcaaaggaaacactcaacagagtgaagagacaactataaaatggcagaaaatatttgcaaattatgcattcaaaaaggaactaatatccagaatatacaaggaactcaaacaactcaacagcaaaaatatcacaaatattccaattcaaaagagggcaaaggatctaaatagatatttatctaacacatatagaaaaggccaataaaaatgcttatcagcaaccatcaggaaaatgcaaatcaaaaccaaaatgaggtgtcatctcaccccaatgagaatgactattatcaaaaagaccaaaaaaaataaaaataacaaatgctggcaaggatgtggggaaaacatactctcatactaggctggtgcaaaagtaattgtggtttttgccattaaaattaatagctacccactcccaaaaaaagacacctaggaataaatttaaccaaggaggtgaaaggcctctacaatgaggccactgccattacttttaatggcaaaaactgcaataacttttgcacccacctaatagtatagccattatggaaaacagcatgaggggttctcaaaaaactaaaaatagaactaccatacaatctagcaattacagtactgggtatttatccaaaggatagaaaatcagtatatccaagggatacctgcagccccatgtttattacagcagcactattcagaaaaactaagatgaaatcaacctctatgtccatcaatggaaaaatggataaagaaaatgtggcatacatacacaatggaatattattcagtcatgaaaatgatattctgtcattcatggcaacatggatgggcctagaggacactatgttaagcaaagtcagtcaggtgcagaaagataaaatactccgtgttctcactcatatgtgggaattaaaaaaaatggatttcatggaagtagagagcagaactgtgggtactagaggctaagaaggtggggagaggttggttaatgaacacaaacttaggaggaacgaatctgctcatctgcagcactgtagggggatatggttcactttattttattgtatattctcaaaacgctaaaagaggattttgaatattcatgacataaagaaatgataaatatatgaggtgacagatatgctaattaccctgatttgatactacacatagtatacacataattaagtatcactctgtatcccaaaatatgtgcaattattatgtgtcaactaaaaacaaaaggaaaaaactataaggataaaaaacagatcagcggttatcaggggttggggtaggggtggtagggttgactataaagggacatgagggcacttttttgggaaacgaaaccattctgtatcttgattttgatggcagtttcatgactgggtttgttgaaatcatagaactgtctcactaagtagggtaaattttttgcatgtaaattgtacctcaacaaacctgattttattttaaaaaacatttttaaagaaataaactaggtaaaacttggtatgttgtttaccgagcaataacttgtcaatcataacgtaattcaacccacttactacatatgttctactagcactctggccttcacccatccttttaattaaatatttaatgcctacattcccacttgactctaaactccacagatccttacctttggttaaatcggttaaatctcagcttggtgggtgacaaaagttccaggaaacaaaatatatgcagttcaatgagttatcttatttatctgtttcctaccatgtactgagggtcattacttttgggtttatgaaatctaggcagagttctctgaagatcattgagattttgccgtggaggtgtttcaatctggttccatactacataccttgtcctgggtttggcaacggaaacagtcacattcaaagcagtactggtccctcagctgcttccggcgctcctcactggtcatcagcatatccaggtagcagatggtgagctgtgcaggccagagagagggaagcgctgaaacatctgctgtgctcatttctttaacaaatggttattattattgctaattattggagtaaaacttgtttttattataaaccaaaaatataagagagaaggtactgcttatagtttctctacccaaatgatcacacgtaaatttttaatctatttcctttcagtctttgctatgtggtaaatatatatgtatcatatatttaaagaacgggtcttatgatctctacccacttttgtatcttagtttttttcactacaggaaaatatcaaaaactgttgtatgtttactaaggtttgctaataaattctataaccattagcaatcagagaagccaaattaatcctggcaaccgaaagggtggcagatgatacagccagattgctcttaaattctaaccaattctatagctgcctcatggaatttaaggtcatccaaatttggtatctttgaaatgagaaaacagttctcttatttgtatctaggtttggaaaaaaaagggggggtagaataatttccaaataggggagagtttaacttgagagtaccaccactgatggaagcattcaaactgactgccttacaccctttcagagtaatatcccctgcctcggatggtgaagggttataaatgagaggatatatttaaaggactcctcggacactctctaacactgagtcccattaagtcacgggtctttaggcaacatcataatgcttgagcattttgcacttgattagatctcttatgaaagtctaattcaaaatccagaaaacagaatgcttgatcttcccctcaacctgttccatctcggctagagcattctcactctcagttgacagtaactcatcttttgacttatccaagttgaagcctcagagtcatccttgacttcactctttcctttacacttgccatccaatccaccaggaaattctgcgggctccaccttaaaaactacccagaatcaaccactttttaccttttccagtgccaccatcctggtctgagccatcattacctctcacctgtaaaatgtaatagtctcacaactggtctctctgattctttctccaggccccctgcactccaccctctagccagagtgattcacataaaatatgtcagatgacatgttctgtttgaaacatcacaacagctccccactttgcctgagtgaaggccaggtccttctaactccccaagtgcaattcaaagtatggtccccgcattggtgccagtgcgcactgtgggttaccagtccatgacgacatgagtcaagaaacaaagtcaatatttagaaatgttttttactaatttggtaagggtaattttatgtgactctaataataaaacattgggctttaaaaaaaaaaaaaaagacagggtctcactgtgccaccaaggctggtgtgcagtggcatgatcacaactcactgcagcctcaacctcccaggtttgggtgatcctcccacccctcagcttcccaggtagctggggctacaggcatgtaccaccacactggctaattttctgtatttcttgtagagatggagtttcgccatgctacccaggctggtcttgaactcctgggctcaagcaatccttcctccttgacctcccatggaattacaggcgtaagccactgcacccagcccttcatttttctaataatttattttcactagattttataaaaatactggtctgcaatagattatgaaggaaaagaaaaactggtccttcgtcataggtagagaagcaatggcttcacataatcccacctgttccctctcatttcccagtttccctcattgctgctgctccaccaggctggcctcccgtctggctccacacacactcctacctcaaggcctgtgcactggctgttccctctgcccttctgccccgtttactatgacaacctccctcatcgcctttgagtttcagtcaaatcccactttctcgttcaggtctaacctcaatgccctattaagagtaacaacccaattcccttacctgctctagtttttcttttcctgtatcatatatcagcttgtaccagactgtagaaattacttctttgcttttaaaagtagaaagtaatcatggcggtatgtgtggtggggggagaagtgaagactttggcagagcaagaaggcaggattatccactgaagggatgcaaaaaactccctagagcagaaaactccatgtggtttttgttatacttaaaagaaagcatctcatgtctacaaagcatgatcttacttgtttgaaatcatagtagggcaaaggcagccaccctctctggcagaaaacaaagctttgggaaggactctctcaagctgtaggggtgatggtggatggctgggctggccagccagatctgtcaaatccaccatggccgtcaccatcaccaacgggacaggagtcacagcctgatctggctggctggctctccatagattcttcacattaggcaaccataacatgctgctccacacacagaaacaagaatatctgcccttaagagatacagacaatgacgttactgagtatctactgtttgtggcgaggcagcatagcacagtaaaaactggcaaaggtcttgggttcaggtaacactgaagactgcacccagatctcttgataagtctgatgctctttttacttttacatggctgcttctcatacttggcagggagagagggctgtagaagaagctggcgtcccttaaggagtgtccgtagcaccgtcaaacctaaaatactcacacctgtgttagagaatgttctgtggcaactgagatccttcagctgagacaacagccactttttgatttcctccatgtttctcttgcttcatgatctgaagccagggttgcctctgaggcacaaagggtcacctataccaggcaagttcctcttgtttctaatgaatgctatgttccaaattccaaataacctatttccaagctcactttttgaaacagcctatgagtaagtctgggacagtagatagattcatcttatactatcaggctctgtgggtcccagtttccttacaggaggtgaggtagcaaatgagcgcatccctatgtcccctcttgggttaactctaggacactaattctgaatccagcccaatggctcttagtcatcaactcccattatcagagcaggtaaatggacagtagttattgggagattacagtgtgcccagtgtgaagccactaactccagggcctgtcatgccagaaaaaaatgtgcttgactaacccaagactttattacaagggccaaaactcatgagtgatcttgtcaggcagtgaatggccaacaggagactagttatttcatttaaccccaataaatgggctcctaaagcctccctcggcatactgtaactgcctggaaccattacctggactacgcaatggctttctaactggcttccccgctgcctgcagtgtacctttcatcttctaaactgctttgagagagatcttcctaaaactcacatgtgatcacgtcatttctctacataaaaacttgcgatggtttctcactgcccttgaataaaggcacacaaggatttccctcagctgtttttctgtctgcctttctagcctccatgtctctccctgaaccccagcctgtcacagttatgtacattgctagacctctgaaacaatgaacaccatgccaacatgtgtctgggcatcactggctaagcgagcctctcctccacactcagcctcctgagagcctctcatcctccaagcttggctcaaatacacctcttcctatggcgactgccccattacctcagagaaagccacccatttttgtgcttcttttatgccaatgaagtctgcagaatatctggttatcaattgtgaagtgcttaatggcaaaaatattttattcatatttttgggaaaaaacagccagattactaactggtaatgacagctaaaatcatgttattagccaaagataaaaacctttattaaagactcattgactcactagttgtaatggaatatctgctcagtaaatgtaaggctcatttagtgggaatgtatatgtgaaacttggccattgatcagtagacaccttaatggcacagaacaaaattgcattaaaatattaatgccattgaccactgctctgccattttagtgcagctcttatagaaaatgcagtaaatcatttctgacattagagtaatataatgaaggagattttctagatcttgaatacatagcttacattaaaatctcaagacaaaatgaactccttttccatgaaaccatcttttcattgtctacaactgagtggataagatgagcaagttaaggccggccacggtggctcacgcctgtaatcccagcactttgggaggccaaggcggtaggatcacgaggtcaggagattgagaccatcctggctaacacggtgaaaccccgtctctactaaaaatacaaaaaattagccaggcgtggtggcgggcgcctgtagtcccagctactcgggaggcagaggcaggaggatggcgtgaactcgggaggcggagcttgcagtgagacgagatcatgccactgcactccagcctgggcgacagagcgagactccgtctcaaaaaaaaaaaaaaaaaaaaaaaaaagatgaccaagttaaaattagaccttgtttcatttctagaattccgtgatcacagttatgaatgtttctgttaatactggctctgaactggaaaaaagcctgaaaaatgtcacttctttttaaagtcaaacctgagtatctttgtgtctcttgtttcacaagttgtgtccttgtttcacaaatcctgctaattttatcttcttaatattatagtcttcaggtaccctatcacaagccaccacctgagctccccgacttcaggctaccactgttatctcttccctggattattacatcaccccgacgctcattctcccaaccttgcctacacatagaaaagtggtcatacaaaaataagcaatgagcaaaggacatcctgttcaataaacggtgctaggacggctggctagccatatgcagaagacacctaccttgtaccatatataaaaattaatacaaagattaaaaatttaaatgtaagaccacagactttatgcaccctagaagaaaacctaagaaacaccattctggacgtcagctttcggaaagaacatatgactaagtcttcaacagcaattgcaacaaaaacaaaaattgacaagtgggacctaaactaaagagtttctgcacagcaagagaaactatcaacaaagtaaacaaacgacctacagaataggagaaaatattcacaaactatgcatctgacaaaggtctaatacccagaatctataaggaacttaagcaattcaataagcaaataacccaagtaaaaagtgggccaaagacatgagcagacacatttgaaaagaagacataccagcagccaacaaacatggttttaaatgctccacatcactaatcagagaaatgcaaatcaaaaccacaacgagaaaccatcttacaccagtcagaatggctattactaaaaagtccaaaaataacaaatgttggtgaagctgtggagaaaagggaacacttatacactattggtgggaatgtaaattggttaacccactgttgaaagcagtttggagaggagctcagaactaccatttgagccaacaatcccattactgggtatatacccaaagaaaataagtcattctaccaaaaacacacatgcactcacgtgttcatcacagtactattcacaatagcaaagaaatagaatcaacctaagtgcccatcaacagtgagctaaaaaatgtggtgtatatatatatatatatatatacacataccatggaatagtatgcagccataaaaaagaatgacatcatgtcctttgtggcaacatgaatgcagctagtggccattctcctaagcaaatcaatgcagaaacagaaaaccaaacccagcaattacagatttctcataaattgtggaaacaaatatttagagaatctatcgaaccaaacacccaatgttctcacttataagtgggaactaaacactgggtactcatggacataaagatggcaatgacagacactggcactactagagagggaggtagggcaaggggtgaaaaactgttgggtaccatgttcactaccagggtgatgggattcatcacaccccaaagctcactatcatgcaatatacccatgcaacacagctgcacatgtgccccctgaatctaaaataaaagttgaaattatttttttaaaaatcacaattaggttactaaatattcttttagcttaattcaaaaggtaaatgaaattacatttcttttacacttatccattcttaagaatggggcagggacttttataatgaatttaactgtgaaatcacaatttagttatttattgaatataatttaataaaaccccgttaaaagtaattttatcatcttaagccaaaaacaaaaatcaaacttgtatgtatttgtattcaacagcctaaacctgaaagcaccggctcatttcagacttaaaggtaccttcatttaaagtgaaactggtcataacactttcagcttcaatttcagaggagcatgtattagaacaaagactgcctatagaaaatgttaatttaagaatggaaaataatctgtgtagatgtcatcatggaccaacacttctatacacaaaccaaatgttattcaacagttgtagcaatctttcttgccgagtccaaacatcagccagaccacctccaccaaagaccaattattctgctttgatacgtaagatgagatttactatagttttgatagattctctaaatatgtttccacaatttatgagaaatctctaatgtcatattttttttttggacactcaccatttgagctctacttttcccttcaggaaactctaatcacaaatggaagaagaaaatcactatgtagtaagcatcatgtgctgggcactgtcctaggtaaataatttgttacttcaatcctgagaatgaagctttattactaaccccctccacactgcgtagtagtaagtgtagcactgaacaaatcatttcccagtttaaaccttacattttcttccataaaataaaaaaaatgaatatgtaacattatctgagttttctaagattccaaagatggtacagactacttaggtcttactcaattttgtagtccttgggttttgttttttgtttttacctattaggcttcatctattgcttcctaaattgaatcaccctataaatattccctatcatcatagccatggtcgtatatacaaaaagtgaatgaaaggcaaaggaaacatcacgtttcaatcatatggttcaacgagttgagaaaaactcacactacagcaacagtgactgaggtaaaattgaatgtacactgagtaaaatgtttcgtttgtgatatcccaaatctaactcaggggttagaattgggtggggttttaaaaattgttttcttcaagtgttttatgtatagtacatacaataaaaaacagtaacatttgtaaacatgcaggaaaaaaaaaacaagaaaatctggccacgcagttcctttgctgaaacccttcaatcatgtcccgctgctcgtccttctcccttacacaaatatttactgggcgcctcctatagaccagccaatgttatgaaaccttcagctaaaccaaggtctgtgataaggctcccatggggtttgtcagtctgatccctacatcttccctcaaattcgggtcacatctaaattctttcgtcgtctattgatgagaactgcttcctactccttgaactcaccattctgtccctggcctctgtgtctatgtctacaatgccttttccagcctcatccaactctaactccatggatcctttcagagtctaggagtcagtcctctggaagcattccttaaccactctccactccctccccttactaatcactcgagtgctcctgctctgagctgctgtaagcctgtgcccatttacaccactgtgcatcttaattctattattgttttctgttctctgtcagtttcctcaactataccttgaactcttgaagtcagggctgggtcttaataatctttgtattagagaaggtttctaaaactgctaccaactcctgacatccagtaaacatgcagtgaattcgtttaatggtttagcaaataagatgactaacagaagaaacagactgtcttaatcccaaaagacatcagattaagactgacattagggatactaatgcattcaacttgtgtcaatcacatttctcccagttgatatggcgccagagaatgctggcagccaatggcattatttgtaacagctacaagttattttaaccaggaactaccataagactgctttggcctacccagctttcctccctgatccatgttttataaaactatcagaacaaatgaatctcatatttaagataattttgaaaaggtagccatcagcaatccagtcaagtgagccatgacttaaatgatattacacatctctctctgtaggaggcggctgaatgaggagacaaaaatccaaagtcaaataaaaaaaaaagacccaataactcagcattacaatggagagccttaaatagcaaagtattataaatgttgctggtttgcaaggaaactgtccaaagagggtccaaaggatggatttatatagagagaaacatggggtgagaaatttccatggcaacttctgttatcacagaccttgtgcaattttccagctctccttgtgtgaggtttgaaatgctcccatcttaaactggcagtagactggctttcatattcccttcctttcaggagccatgggacaccactgaggactgccagtcatttgtaaatgtctgagactctattccagctttttttttttttttttttttttctgagatggagtttcactctgtcgcccaggctggagtgcaatggtgcgatcttggctcaccgcaacctgcgcctcctgggtttaagcgattctcctgcctcagcctcctcagtagctgggattacaggtgtgcgccaccacacctggctaattttttgtatttttagtagagacggggtttcaccatgtcggccaggctggatgcaaactcctgacctcaagtgatccacctcccttagcctcccaaagtgctgagattacaggcatgagccacggtgcccagccctattccagctcttattttatctttaagaagtctcattaatttactcaacaaatgttgattgaggaacttctgcctcagttgctgttgagtcttccattgtgaatcccatattctgacactcagatcccaaatagctcatattaaaactgtgggtgccctaatgagcactaaagccaaatgcaaagttcatgataggaaattaccaaaatgtctaaaattttttcccaaggaattttaactttcaaaaaattaatacataatatttatacatatttatggggtccaggtactattttgctacctgcatacgatgtgtaatgatcaagtgatggtatttaggttatccacgacctcatgtatttaccatttttgtatgttgggaacacaaaatgtctagatttattccttaatttaaagctaatatttgtacaataaataggaattaccctgcttaatcaatgcctcaaactgtcttttctcatggctctccctctcccctacctctgctccaaggggtcagtttgaaaggcataggatatattttagttgttgggggatggctacaggcattagttaagcacacgccaaggacacaagtcttctccaatgatgcaacaatcccacacgatgaagaactgtcccattcaaaatggcaatagtgtccccacaagaaatactgccggtcattagagtaagctcaatataatagagagtcgattcaacaaaaagttatcaaatgcctcctggatgcaaagctaagtgctaagagatacagaaataagacacgattgtctgtcctcataaagctctaaatagagaggtctccaaaacagccataatatgtgccaaaaatgtattaataaccactataagcgagaactcaaaggaaaagaacttcttctaatatgggaaatcagggaaagagttacacaagagatgtgattgaaagggtatcttagtccattttctgctgttttaacagaataccacagactgggtaatttataaataaatttctcacagttctggagtctgggaagcatgatgccaaaagcatggcaccggcatctggggagggccttcttgctgcctgataacatggcagagggcgtcacatgaggtggcagcaggagtgtcctcttcttataaagccaccaatctcatcatggggttcccaccctgataaccttatctaatctggattacttcccaaagactccacctccacaaagcatcagcaagaatttggggataaagttttcaacagatggaatctgggggacatgtttaaatcataacaaacagcctcgaagggcatataacattaagacaaagagacacagtggacagaaacgatgatgaatcaggggaaacactgttcagcaagacctacaaaatggaatggagaaatgtttattctcttaaactggtatatatgaaggacttgtggggagaaccttctttttgttgagaagatgccttgctaagtaccacagggaaaaatatctgagtctgaagggctttacactgagtggaaatgtctcgtatttggcaagagggaggatttgcttgttgctccagagatggaaagagaaagatgtgaaaaagtgaaagcagcacctaaagacaaggtgtcttattcaactaaatgaaaagcaaccacgggagaatgactggcagccgagcctaggaaaatagaagaaactttctttgttgtttctgaaaattccaaccaactctaattgcttttgtcaagttacttggtttgttttttaatttgcaaaaacatcgtcatcatcgacaacagcagcagccgctcttcagcccccaaatgaatattgctgaaaatagatagcggtttcatctcttacctgccttgaagtcctttgcggccccagaaaaaaaagagaaaaaactacattgtccatctcactgacatctatcccagtatatttcatacactggtcctaaaatctggaaatttagcgagtagttgtataagaagtggctccttccactgaaaatcagtttggggagaatcttgtcaaagccaaatccctgtctacataaaatatggtacctctgagttgaggttttattggctgagtgctgcataaatgcaataaaagctttcagtactgttttccttgcaataaatatccactttagcaaattggaaaggagaaggaaacggggttctggaaagtagaaatatctgtaactcagaactcagcatgggtagtcactgtgcaaaccagtgcaagcttaggttcagagccctggagcagcccgtttgcagctgtcttgtaagaaggttctgcaccaaaagaggctggctggacagtctgtcaaactggaggggtcaaggccagttcactgctggaggtcatcctccctgtcctctattccctttgcatctttgctgaaatgatcacccagagatgctgatgggtttgtcaagtcccaatgtcagcctgagacagtataagctgtttgctttactagcacaaagttaacatgcatcattaccttcaatgtagccagtggccttccgagtgaagaagtcttggggatcccactcacaagctgggatgcccccccctgcccacggaaggatatgagaggctgctcagctgttgccactgaggagatttcatgaattccctgtgtgtgcataaaacacacaccctctgtcatacacaaactcctctctctctcacacacaggacaggaactgtcatcatccagaaatatggtgacctctcccctaaaaaattagcccatttgtaatttgggagaagaaaggataggttgctggggagaggtgactgaactacaaatactctcactggcagaaggacaatgaaaagttgtcccctcaggcacaatcagttttagggacgggccgagctgagagggtctttgataggaaagaaggccaggctgggaagcatgagtttccttacctcctctcccacctcgatgtctcggactgctcgcagtaagaggtggggcccattgaacacaatcgaacagttggggtcacagctgtgattgagcaaagagatactggaaaaaaaaaggggggaagactgtcacagctcagcaggtagagtcaactaaatttaacaaatgcagtgggtaaaatacaccttcctttggggggcagcagcaggtagggttgacaggatgccaggggttcagtactcggggatgcattcacagaaatgtcactagcacacctcccacgaagtgcaattctcctcaagatgcaggctaactagggaattccgtcatttaataataaaaaaatttcctgagtcctttttggggattggggcatagttgactgattagataacagtcaataaggcaacccaacacgaaggtcagaaagaaactgactcagaaagaaatacttagacagctgggtgtggtggctcacgcctgtaatcctaggactttaggaagccgaggtgggtggatcatttgaggccagcagtttgagaccagcctgatcagcatggtgaaaccctgtccctactaaaaatacaaaaaaattagctgggtgtggtggcacatgcctgtagtcctagctactcaggaggtggaggcaggagaatcgcttgaacccaggaggcggaggttgcagtgagccgagatcgcaccactgcactccagcctgggtgacagagtgagactccatctcaaaaaaaaaaaatactcagacataatgggatgcagcagccaagataccactgacctctcccataggatctcatttgttgagctcctttggagaaatggccgcctttgctagaacatccacactgaaaaataattaggactatttgctcttaaatagagagctgacgttattttgccacctacatcctgatgcatcctgggccatggtccagtcattttattaccttggagggacatttcttaccatctgggaaacaaaatggatttaagctgctatcaggaattggtaataattagaatgagcacttactatgtagaaacactttcttgcacttgagcatgttcatcacatttaatcctcacaacaatcttatgaggatcatttacaggtaaagagactgatgcacagaaattaaatgacttgctcaaggacatacagctagtaagtggtgatggaatttggaccaggtggcctgaacgcagagcccatgctttgaatcatcctatgttactgccttttgagaaccacctaccagtagacctgacctacagttaatgacaattgtgagaaataagaaaaaaggctgaattcttagattcacaattattagaaagtctaaatttgtatttggactcttatggcataaaaacaaaatgaaactgggtgtgcctatagtgcttgtggagagacggtttcatagctcagtggtaagagtcagctcagcaatagctggagagagcattcaggggccaaagcctgagagttttcttgcctccttgagtgaaagggctcagagtgtgccaactcgaaagacaacatgaacccaactgatacgtacggcaagtccggtgaaatcagcatgtgctgcagctcaggaaactggggaataaccaaaaatcagcccgatggttaattagcacccaccgtcctcaacttcttcacccaaagtccccctgagaacaagagtttagttctgagatctgcccctttgttaatatcacagcatataatgtggggttataaaactgttttctttcaacttaacattttccatttttttgtaatttattgctaagttttaagcttggctcttgaacaagctgcagcaactgcctttctaactacctccaaagggctggggatttgggtgggaatgaaagtgtgtcttccagtacatgaagtaccatacaccatacctgggatataggccaacaccaacttcctgcatctccgcattacagatggtgaaagagttgcagatcacctgtaaacacaaggggaaccatcagtattactagagtcacttaagaaacttcatagccaagagaataaaaaacgttcaaacccaaatgtaggagcatcttagtagttgcttaagaaagagccaagccaatcatggatgctctttgacttacaacagaatttatctgggatatactccccctaaaaacatcaggtggttaagtgcagaaataccaacctcctgggagaaaaaaaaaaaaaacagacggaaaccagcagaggaaccattaatttcagtctcattatccactaccccaaagttacagttacatgaactgttcaaaatccagaatatgaataagctatttattgaaaactagactcctgctgtatcacgattttttcaaactgcatgcagtttccaaatgccactgtgtatctgttcagtgatagcaacttgtctcttactcctacagaaagcgaagtatcccgtgactgagcctgtcgtctgatgcgtgttggtgaagaccacagggagcactggaggtcatttagtcaagccatggtatttaccaggagtccatcactgggtacatgacacagtcctgtcttatgcagggacggagcagaagcagtaaaaaacacaatcgactgtgctcaaggaacttaaaaacctcgtttgtgaaataaggttgatgtatgaggtcacacagaaccatggaaagagcactggaccagaatcaggaaatctagattctggctaaaatcactgcttcagacaggtgcgaggaaaagagcagtgaagaaaaacaaaacaaaagttcctgcctccgtggagctcaagttctagttgaatacacagattttttaaaaaacccaatgatagaaaactgtcacatgtagataaatgccaaggagagaaacaaggtccttacagagaaaaaaagttgtcaagaaagctctttaggatgagttgacatttaagcaatgacctgaagggactgctgaaatgaacgtgtgtatttataggcgataaaggctcatatcaggagaaagagcaagtgcgaaggccctacgctaggaatgcccgtggtaacagaggaacagcaaagaggctagtgtgaccaaagcggagcaagaaagtagggggcaaaacacgagctcaaagacggagtgggatcacttacggccctactgccatatttgggttttgctctgaagaagatagaaagccactggattttgagccaaggcatgaaggagtctgacttctgctttaaaaggatcattctggctgttgtgtagagaatgggctataaaaaggtgaatggaagtggagaaaatggttaggaagtcactgctatagcccaggtgatagacaatggtgactcggatgtcggtagcaggagaactgggtagcacagccaacaggccttacttactgcgggacggcttgtggggaatgaaaggagtcaggataatgctcgagtttttggccgaagcaagtggaagatcatagctaccatttattaagatgaggaagaatttaacaggaacaaatttggttacagggagttgagagcaagtccaacagttctgttttggttaagttaaatttgaaatccaagccaagactaagaatgaacaattggagttcacaagaggagttgcgcctagagatataaatttaggatgaaacatgacaaaggccatcaaaaaacaaaaaaaggagaagaggctaaacatttgagatgaaccagagactacaaatggatgctgacttgttataaagtttctgtaaaggaaaaagtgatgacgaatttctcaaatcaggtttacatgaaagaacacgaagtatgaaaacacactgagtcctctgagactcttccactgctccaaacagctcttacatgaaatctagtgcactctagcatgatttggcttttttccctctaaatatataaaattgcagtttcaaatcaggagcaaaattatacatatatatttgtaaacaaatgctaaattgctttaaggacaactattttgcattaagcagcaacagtacattgtctatatatacttatgtataaattggatggtaaaaatataagacagaaagtcctacgtttaatttttgaaattttaaacatttttaaatgtgtataatttgggaagggatacaagttttaacaaatattttaaagtataatgagaactttagttgaaataatccaccaacaaaaaaaccaggtcaaacacatctgatctgttaacttctgaatcaaaccagcatggttttttcctggactatgaagcaaattaacggttttttcaaaataggaaaaatctttatcagtttttttccatcggtttatttcatggattctgatggaatgtttaagaaggaaaagctaacaagaggaaatgtcagcttgcttgtctcttccactgggaaactcttcctgatttcctaagatgacttccctctttagcagcatttatcatactggatcattatttacccatttacttgccatcatacacaactggatcgtaaaatacttgggagggcagacacagtgtttcattcatcactctagtcctgtacctggctcaaagcctggcaaacagaagacactaataaatctatttccttttcttagagacaaggtctcactctgtcacccaggctggagtgcagtggtgcgatcatggctcactgcagcctcgaactccggagctcaagtaatccaccctcagagcctccggggtaactgggactacaggctggcaccaccacctctgactaattttttaaaactttttgcagagacaggagtcttgctatattgccctggctgaccttgaactcctggcctcaagtggtcctcccgtctcggcttcccaaaatgctgagattacaggagtgagccatagctcctggatttcatctatattagtctgagtgttacgtgttagtctttctgggctagtaaacagaaggtttagttttttgcctactctcacttttatttaaaatgctggctccatccagcactatctcaattaacaacctgacaggaaatatttttgacatacacaactgatagcaacagtggatatgcagaagctctctggcttttttttagtgcaagaataggtagataatatgtccatgtgtgctcaataatttgaaaggaattgctctttatatcaagaattaaaagaatggaaataaagcccagaaataaaagtttaaacatttttcaaagtactgtctttgtgaaaacagttttcttagggaattgcacaggttaaaacaattaatgaatgcttacttcacaaaaagataacatttagaaaaaaatattaatggtactacttcaataaaaaataaatgcaactgggttaatgaattctttctaaaaattaagcttgagtattactttagaaatttttaccatgtcttaaaactaaaacacatatttaaattgttttattattgaatgcaaagttatatttactttctgtaatttttcctttaaactaattgaaagccttcatatataatattatagtttttctagatgacaaaaatctagtgagttgtcattgagcctctgtattttataaaaacaactacagtgaaacttaaaatgttctgtgaaccaaattcttatgtcatttggttcagagtctaggtccagaatctgacatttgtgtcctgaggttagcaattccccggtagattagacacaaatagcaaaatcaataccaacacacaaagtgaataccttacaaaatgagtgtattaccatgtattcaaatttcatatttttcctgaaattcttaggactaaaggctttgtattgtagcagcagttaaactgagatatttgcaacacaagagaaaatcactactaagccattatcttgcaacggtaaaaatcagaacagccataagcaaactcacaaccaatcagagctgagtaattctacaccataagacaagaacccagccacttcccagccccctcccccaattactgaattctacacagcctatttcaaataatactttcaatttcccaatatatatacaaattttaaaacacatttaaaaagaaggggattcagtttctgaacacaactatacagaggtttcctccaagaccatctgcatctcctttaaaacttttctgtctaaaatgttcagtacagtgtctggcacagaagactttaggcacatcaagtttactaactagagggactaaatatgagttttcaaaacggagtttaatgtacttagttttattaaaccctggacagaaaaactggaaggaggaagagttggcaggtacgaaaaccagaagcagaagcttttacactacataactgcctctgccccccggcaccccgactcctagaactaatatttctctaactttaaaagcacaataagaattttaatcagggtatatttttctctacccacagaatatgacaggttattaagtacagatttttttccagaatcttctcataaaccttaagagattaaaaattgtatctcccaatccctccttatctgtatggcaaatatttatccatccttcaggacccaattcagtccttgcctgtcccattgcctcttttggtcacatagttaaagggtttgaaatctccaaaccagaacagcgggaggggaccaggctggcgacggaggtcagctcaggagaggagaggctatacttcttaaatgatgattcgcaaatcccagaatccacaaagtgttaccggaaggtttacgagagtacaggtgatttcggcatctgtttcaatttcaattaaaaaaaaaatccataatagaaacaatgaccaactacatttccctttgccaggaagttgctggagggtctcaagttttaccagggagcatgctgtaaggttgcggggacaaaggcccatgctcacgacttagtcactaagctgcatcttcactacactgctagtcttgcgacagtttgacattatagttttccattgtttcttagtcacgttatttcatttgcaaacctaatggacccctgattaaagacagaagcaagtaggagatatgactccaaagcacaatgtagacaaatggggttgcatcaaactaaaaagcttctgcatagcacaggaaatggtcaagaaagagacaacccacagagtgggagaaagtatttataaaccatacaacggataagaggttaatacctaaaatatataagaaactcaagcaacacaatatcaagaaaacaaacaacccaattttaaaatgggcaaaggatttgagtagacatttctcaaaagaagacatataaatggtcaaaagattcatgagaaaatgctcaatatcaccaaatgctcaatcattaggaaaatacaaaataaaatcacaatgaggtatcacctcatgcctgtttcatcaaaaagatgaaagataaaccttggtgaggatgtggagacaagggaattcctgcacactggtggagtctacattagtccagccattatgaaaaactgtacagaagttactcgaaaacctcaaaatagaactgccatataatcaagcaatcccatttctgtactcaactaactaaaataagagatatccgtgctcccactctcacgtgcactgcagcatttttcacattagctacgatatggaattgacctaagtgtccatcaacaaatggatcaagaaaatgtagtatagatacacaaatggagtaatattcagcccttaaaaagaaggaaattctgtcatttgcaagaatatggatgaacctggaggacagtatgttaagtgaactaagccaggtacaaaaagacaaataatccatgatctcacttatatgtggaatattaaaaagtcaaactcatagtaatagagtataatggtggttaccagaggcatgggctggggagagaaatggggagatgttggtcaaagggtgcaaagtttcaccttcttcacaggaggaataagttcttgagatcaccacagcatgatgactacagttaataataaattgtatatatatttcaaagtttccaagaaaaaatttcaaatgcctcaccgtaaaaaatgacatgaggtaagggatatgctaaattagcttgatttaatcattccaccttgtatacatttaccaaaaattcacattgtactctaaatatatacaattgttattcgttaattaaaattttaaataatttaataagacagaaagcaaggatgttgaaaaacaagggaaaatacataaaatgataattctataaatttgtctcaagatgctttatatcatgacttaccaggttgaaattcttatagagcatctcaagacatctctaatatttgaaaaaatgttaggaggagaacatacactgaatacgtaatcttatttttttttttgcagatggcgtgaagaccacgaaagtccccagtgtgtgatttggaatgtgcttgcactttgctacctaaaacctttcttgtcttataatcgagaaaaagaacatagaagtcatgaaacataatccagctggtttcttaaagagttaattataagaatgtgaagcatcaggtcatgaaagcaatatgcaacctaaggcccaaagcaataatatttcatttaaaaatttgtgttgattaaggccaggcgcagcggctcactcctgtaatcccagtactttgggaggccaaggcaagtggatcgattgagcccagaagtttgagaccagcttgggcaacatggcaaaacctcgccactataaaaaatacaaaaattagctgggcatgatgccatgcacctacctgtaggtccagctactcaggaggctgaggctgcagtgagccatgatcgcgccactgcactccaatgactgtccccgccacaaaaaaaaatgttgtggtaataatgtttttacaaaactaatttacagcaggttaaaccatgcgatatcacgtgataaaggagaaaactaaaaatttgtctttatatgctatgattattaaagattttacaaattcactttgtaatacaagtcaagtaaaaaataaaataataatattatttaagaaaactctttatcccaccacacatgacaatatatttgggaatttgtctttctagactgagatacatccaactgttttcacaactgcagtggtgtctgtcccatttcaagctctggccacaaataagtctgcagtgcacactagacacacaaaatcctcaacaatcacttgtcaaggctaaaatcaatatcaaggccaatatcataaggaatggcaatcataaaattgtgctttctattttatctctctcccacagtcaaactgccaaatgttagcaaatgaagcccctttagataacatgctttctaaaatccacagattttcattttctaaaagctttactcacaacagaacttataaacaactatccttgctaatagcaaaatagtcacatatttgtccactgttccttccctgaggctcttacctggcatttcacctccttaaagccatctgatgaaacaagcacttaccacagatgtctgtcaaatacgtagagaaggtataaagctctgacacatcattttcattgtttcattttcttcccatatcctgaggctcagaaattcttcaataatttattacaagacatcattataggtttccatagctccacggtcacatctaccaatttcatttagatgtgctcctacccaaaaggtttatcacaatgaactgaactttctcccatgtatcgcacttaaagattcttttgttcagcttaaatcttcaaaaacattctcttctatgatactctagtttcattattctctaagtaagtggtgtggaaatccacccccagcagtaccaggacgcctcactgtaatcttactcccagtactaaattcctaaatcaagtatgctaggtgctgcatagcacctgactgaagttgaattagatatggcagcgtgtggctcaagttatctgtttttccgtcaaattaatggagaaaaggaaactacagaaaaacgttacacgtgaaaggtaagactgcacactaatcaactgcttaaagtaatccccaaatgaaagatacagtgcgtgctgaggttcctttcactatgtagaaattaaggtgaatattctctccgggtgaacttttggcaggcaagggtttgccataccgatgatgcctgacatctcagggagtgaaacccagaagcaggtatttcacatgacagtagctgaagtgtgcatgactcgtgtacaagctgtgcgggcccgcatgaaggtattttggggactagtgcgtggctgtttctggcagccaatgacaggctagatggggagcaccttggggggccactccttctttggttgcccaagcatgcctgatccctggatacagcccgataacctagtgggcaggagccagggaagaacaaacacagatcagacgagagagagtcacaactttaattatgcagtcaagaggcatcaagaaatgagtctctgaggtcagacagcccctcttttgatctctccaggtatgctcctttatttttggaaatatagaaagaaataaaagaggaaatttatcatggcttcattccaactcctacactgttcctttgtacagaagtagctcataattcttccccttcttcttccagacacttttatagatggccagatacacaaatcagactggtgggatttcaatgcaaggatatcatttgatcttttgtcttctcttctggtaccatttttaactagtcaccatcatgaatacataaatagtgccattcccagcctctttcctgaccagattcctgagttggtaagtagctaaaacaccagcatactgcccctacaccgcttcagtgagttgctgcagcaatttgcaaggaaggttcccctttcctgactcaagagttcatcagaatgtgaagaaaagaggagttcaagaccaccctggccaacatggtgaaaccctgtctctactaaaaatacaaaaattagccgggcgtggtggcctgaggctatattcccagctactcgggagggtgaggcagaatcacctgaacctaggaagtggaggttacagtgagccaagatcacaccactgcactccagcctcggcgacagagcgagactccatctcaataaaaaaaattaaaaaataaaaaaatttaaaaaaaaaagaatgtgaagaaaatagataatttagaaaagtagattaaacatattttcttttgtaatggacattgctgaaaatacagtttgacaaactcttcttagctagttagcaggaccctcttgactaagaaagcattatagaagtatcggtttaaaaagatagacaggccaggcaccatggttcacacctgtaatcccaacactttgggaggccaaggcgggtggatcacgaggtcaggagatcgagaccagcctggccaatatggtgaaaccccatctctactaaaatacaaaaaattagctaggcatggtggtggcaggtgtctgtagtccaagctactcgggagactgaggcaggggaatcgcttgaacccaggaggcagaggttgcagtgagccaagatcgcaccactccactccagcctggcgacagagcaagactccgtctcaggaagaaataaataaataaatagccaaaccctggcctagaggagacaggctgactgttgggtccagatctggtccccatcaacttttctagtctcttctctagtgtctgccttctcatgttttcctctcagttttcctgtcttcacaccttcatgtctctgccaggtggaacagtcccactgcttagaatgttctcccctccttcctctagctactgaaataccactggtcccttaagaacggttcgaaagtcttttcctgtgggaggccttcatgtcattgaaaaagaagaagagagagggacagctgcaatcactgtggctccagtcggtgccggggagactgggtggtttggactgggaggaattctccacagtgcagcatagcggctatggcaaatcatggccagactgtttctttaggtgggtcacagatccatccctcctcaccttcccctcagggaatttcagcaactccagccaggggtttacggacagaactctgatctccccgggacacagcactggggggaggggcagctatggtctctatgttcagcagacttagtctttcctgcctgctagctctgaagagtccatgcagtctggacaaggggaactccccccagcgcagtgcacctgctctgccaaggggcagccacactgcttctttaagcatatccctcatcctgtgcctcctgactgggtgagacctcccaactggggtcactagatacctctgacaggagcattctagctggcatcaggtcagtgcctctctgggaggaagctcccagaggaaggggcaggcagccatctgtgctattctgcagcctccactggtgatacctccaggtgcaggaagcacccaggtgaatacggtctggaatggactcagcaaaccacagcagccctatggaagagggtcttgactgttaaaaaaacaaaacaaaacaaaacaaaaaaaaacagaaagcaccactaccaccgacatcatcatcaacaaaaaagactccacaaaaaccccacctaaaggtcaacagcctcaaaggtcaaaggtagataagcccacaaagatgagaaagaatcaatgcaaaaatgctgaaaactcaaaaagccatagtgcctcttctccttcaaatgactgcaacatctctccagcaagggcacagaactaggcagagtctgagctggatgaaatgacaaaagtaggcttcagaaggtgggtaataacgaacttcactgagttaaagtagtttgttctaacccaatgcaaagaagctaagaaccatgataaaacattacaggagctattaagcagaataaccagttgagagaggaacataaatgacctgatggagctgaaaaacacaacatgagaacttcacaatgcagccacatgtaacaacagctgaacagaccaagtggaagaaagaattctgagcttgaagactgtcttgctgaaataagacaggtagacaagattagagaaaaaagaatgaaaaggaatgaacaaaacctccaagaactattggtttatataaaaagaccaaatctacgaatgattggggtacctgaaagagctggggagaacaaaaccgagttggaaaacataactcaaggtatcatccaggagaacttgcccaacctagcaagacagaccaacattcaaactcaaaaaatccagggaaccccagtaagatactccatgagaagatcaaccccaagactcataatcatcagattctccatggttgaaatgaaagaaaaaatgttaagggcggccagagagaaaggccaggtcacgtacaaagggaagcccatcagactaacagcagatctctcagtggaaaccctacaaggtggaagagattagggatcaatattcaacatttttttcgtttgtttgttttgagacagagtctcactctgtcacccaggctggagagcaatggaacaatctcggctcactacaacctctgcctcccaggtacaagtgattctcctgcctcagcctcccgagtagctgagattacaggtgcatgccaccatgccaagctaatttttttgtatttttagtagagacaggttttcaacatgttggccaggctggtctccaactcctgacctcaagtgatctgcctgcctcagcctcccaaagtgctgggattacaggtataagccactgcaccctgcctcaatattcttaaagaaaataatttccaacccagaatttcataactggccatactaggctttataagtgaaggagaaataaaatccttttcacacaagctaatggtgaggaaatgtgtcaccaccaggcctaccttgcaagagctcctaaaggaagcactaaataaggaaaggaaaaactgttaccagccactacagaaacacactgaagtacacagaccgatgacactatgaagcagctatatcaacaagtctgcaaaataaccagctagcatcatgatgacaggatcaaattcacacataacaatattaaccttaaatgtaaatgggctaaatgccccaattaaaagacacagaatggcaagctggatgaacagctgagacccatcagtgtgctgtgtttaagacacccatctcacgtgcaaagacacacgcaggctcaaaataaagggatacaggaaaatttaccaagcaaatggaaagcagaaaaaaagcaggcattgcaatcctagtttttaacaaaacagactttaaaccagcaaagatcaaaaaagacaaagaagggcattacataatggtaaagggttcaattcaacaagaagagctaactatcctaactatatatgcacccaatacaggagcacccagattcataaaacaagttcttagagacctacaaagagacttagactcccacacaataatgggagactttaacaccccactgccaacattagacagatcatcaagacagaatattaataaagctattcaggatctgaactcagctctggataagtggatctgacatacctataaaaatctctaaccccccaaaacagaatacacattcttctctgtgccacatggcactcactctaaaattgatcccttctaattgttttactaattggaagtaaaacactaatcagcaaatgcaaaataactaaagtcataaccgtctctcagaccacagcacaatcaaattagaactcaagattaagaaactcactcaaaaccacacaactacatggaaattgaacaatgtgctcctgaatgactcctgggtaaataatgaaattgaggcagaaatgaagaagttctttgaaaccaatgagaacgaagaaactatgtaccagaacctctgggatagagctaaagcagtgttaagaggggaatttatggtactaaaagcccacatcaaaaagctagaaagacctcaaatcgacatcctaacatcacacaactaaaagaactagagaaccacgagcaaacaaaccccaaagctagcagaagacaacaaataaccaagatcagagaggaactgaggacagacacacacacactttccaaaaaaaaaaaaaaaatcaaagaatacaggggctgagttttttttttttttttttttaaataaaataggccactagctagacttaaaaagggagaggaatcaaacagacacaatgaaaaatgataaaggggatatcaccactgatcccacagatatacaaccaaccatcagagagtactataaacacctctatgcaaataaactagaaaatctagaataaatggataaattcctggacacatacatcctcccaagactaaagcaggaagaagtagaatctgaatagatcagtaacaagttccaaaattgaggcagtaatagcctaccaaccaaaagcagcctaggaccagacatattgacagctgaattctacaagaggtacaaagacgaagtggtaccatttattctgaaactattccaaacaattgaaaaagagggactcctcgctaacttattttatgaggccagcgtcatcctgacaccaaaacctggcagaggtacaacaaaaaaagaaaacttcaggccaatactcctgatgaacatcagtgtgaaaatcctcaataaaatactggcaaaccaaatccagcagcacatcaaaaaacttacccaccatgatcaagtaggctccatcccagggatgcaaagctggttcaatatttgcaaatcggtaaataaatgtaattcatcacataaatagaaccagtgacaaaaaccacatgattatctcaatagatgcagacaacgcctttgagaaaattcaacaccccctcattgtaaaaaccctcaataaactaggtattgaaggaacataactcaaaaatattaagagccatatatgacaaacccacccagccaatgtcatactgaatgggcaaaagctggaagcattcctcttgaaaactggcacaagacaaggatgccctctctcaccactcctattcaacacagtattggaagttctgaccagggcaatcaggcaagagagagaaataaagggtactcaaataggaagagaggaagtcaaattgtctttgtttgcagataacatgatcctatatctagaaaactccatcgtctaagcctaaaagcttcttaagctgatgagcaacttcagcaaactctcgggattaaaaaaaaaatcaatgtgcaaaaatcacaagcattcctatacaccaacagacatgcagagagccaaatgatgaataaactcctattcataattgctacaaagagaataaaatacctaggaatacagctaacaaggaaaataaagaatctcttcaaggagaacgataaacctccgctcaagaaaatcagaggacacaaataaatggaaaaatattccatgctcatagataggagaaatctttattatgaaaatagccatactgcccaaagtaatttatagattcaatgctattcccattaaactaccattgacattattcacagaattagaaaaaactattttaaaatccatatggaaccaaaagagagcctgtagagccaagacaatcctaagcaaaaagaacaaagccggaggcatcatgctaccaaacttaaaactacactacaaggctactgtaactaaaacagcatggtactggtacaaaaacagacatatagactaatggaacagaatagagaactcagaaataagactgcacatctaccaccatctgatcttcgataaacctgacaaaagcaatggagaaaggattccttatttaaaaaatggtactgggggaactggctagccatatgcagaaaactgaaactggaccccttccttacacattatacaaaaattaactcaagatggattaaagacataaatataaaacataaaactataaaaaactccagaaaaaaatctcggcaataccattcaggacataggcataggcaaagatttcatgaagaaaacatcaaaagcaattgcaacaaaagcaaaaatggacacatgggatctaattaaagagctttcgcacagcaaaagaaactgtcatcagagcaaacagcctacagaatggaagaaaatgtttgcaatctatccatctaacaatggtctaatgtccagagtctacaaggaacttaaacaaatttacaagaagaaaacaaacagccccattaaaaaaatgggcaaaggacatgaacagacacttctcaaaagaagacatttatgctgccaacaaacatgaaaaaaagctcaacatcactgatcagagaaatgcaaatcaaagccacaatgagaatctcacccactcagaatggtgattaaaaagtcaagaaacaacagatgctggcaaggctgcaaagaaatagggatgcttttacatggttgatgagaatgtaaatttgttcaatcattgtgcaagagtgtggcaattcctcaaaggcctagaagcagaaataccatttgacccagcaatctcattactggttatatacccaaagaaatataagttattctactacaaagatacatgcatgtctattttctttgcagcactattcacaatagcaaagacaaggaattaaatgtccatcaataatagactggataaaaaaatcatggtacatatacaccatggaatactacacagtaataaaaaggaacacgatcatgttctttgcagggacttagatggaactggaagtcaatatcctcagcaaactaatgcaggaacagaaacccaaacaccacatgttctcacttataagtgggagctgaacattgagaacgcatggacacagggaggggaacaacatacactggggcctgtccggggattgaggggcggaagaacatcagcataaatagctaatgcacgctgggattagattaatacctaggtgatggggtgatagctgcagcaaaccactatggcacatgtttacatatgtaacaaacctgaacgtcctgtacatgcacccccgcagttaaatttaaaaaaggaaacagcacagcaatattaaagatagtactgcctgaaataccacaatttaggttttttctctgaagagccagaaaggagatacaggaagagctgaatacaagtgacaaagaatctgaacaggagaggagagatggtctcagagttgttccaaacttacttgtcctcaaagctctcctccaccaccttcctccaccgcatgtggaggccacctaaaaatcacaccactcaacacattgttttctatcaaacaggtctttacactaaatcccaaatatgttgtccatgagaggaacatctgacgttcccacgccactcacgcctcaaagcacttcacctcacctcttccagttctccaatcccctcacaaagaagctatgagtacagtatcttcatgaaagaaaggtaagagaactcaacagacgcttctgaggctacatggtccgatgttctcacgcatcaaggaaatttggtcaaaataacctttgcagaaaactcagttatgaaggaagtacgtacaggcagagtggggagggggttaagctaaaggtcgggtctgaaacacagtgttgtacactagacccatcagaaggatagatttgttcattcattaagggtctattatgtaccaagcacagcgccaggcactaggaagaaaagaggaaaaattgtcccttttaatcatgttgctattatttcaccgcccaagtaaaacaaaaatgtaaaaaactccccatttctctctaattttgacaaattttagccttcctcagccaaagattattttcctgactattggccatatttctttgttaagtcactctgtcaaaacataagttgcaataatgcggggcagcgtcgaatctgccagatcaatttagaaacaaatgagtctgctgctcttccgtggccctgggaggcgggctggcctccacgtactgtcagatcgtccacaggaagaattgctggggattactgaagaccagctgggaagcgtcaactaaaatggatggcctttgaattttccactctcccattgtctaactatagccagccgccattcccaaattaatgccacagagagagagatattctctcctaaggcaggctgcaaagataaatcggctacaaaagagcaagtagctaaaggaagaaacagaaaatgaagccttggcactctgtcatgtgaatgtcacagtatttgcaggaattcatacacggcacaaccagagacagaatagaaaagtaagcttccttcctaccccggtcctcctccatatccccccaaaacgaacccaattgtttcctgttttgtgaatgccttctgctaccccatgtcaccgtattttaaaacatcagggattcagttgctttatgtggggtaaaatgtgttaaatgtgcctgcatttctaaaccatcggctaatgagattttattaggaagagcccagaaataaattaccagaatttaccagaaagctataaaatggagggattgtgaggattaaatgagaaaatacatgtgggccttggaatgactcagggcatataggaagcttagtaaatggtagcaagatcataattattaccatagttcgatcaactgtaagacccactcaataaacagtccacaccattatgttacgtaccactaagaaaaaacactaccaattaaactgtcagcctgtgtattataaatcagatatctcagaattaatgaaatacagtatcactacatatacctctaggtttccagaagtaagtcacagtgtacgtaactagtgacaaagattctttacttggccaaactcagaggagattctttacttggccaaattcagaggagattcacgcctctgaatctcctaggtccatccgtgttgttcctcaaaatccagttttagcaaaagaaccctgcctagccggtttcgccagaacctcggtactcagaatcttcatgttcctcatccttcaccaccctcgggtgctgtctgatcaccctggcctgtcttcagcaagaatccagttaggtaagaggggcctcaaggtgactgagaagatgcatctggaacttgcttcctccacaaagaagaatcgaaacagcaggacggaatcgcaactggaaacagcaggacggaatcacaactggaacagatcatctaacagagaacagtggaattcaacatggaagtgacaggagacgcctaaggcaagaaaggagagggaagcaaggcagcctctttggctgggaccctgaagaggctccccactgtgtggagagagtaagtgagagatgcccagccgtccacattcccacatggactcctgtgatccgagccacaggagagccccttgtggtccttagactaacagagtgctgcccggggaccacgctgtggcactgctccagggagggagcttgtgctgggccccacatactgctcgagtcctaagcagctacagcacagcaccattttgagggcccagcttccaccaggcagcatcctgccctgggccccaaatagcccttgaatgtccacattcctggagccccattgatatcctccaccacagccactgctggctcctgctgctgccagggctgaagcacaagccactagcagtgaccctgtggccccagcagcaaggccaccatgcacatacaagtaccctaggacaggttaacccacctgcagccaccacctaggaccaaagcacacactcttcaggacacctggcccagttccaccagccccagtgaccaggcaagccatgcaaaggcctggggattgccctaccccgtccatccaccactgtgggcagctgagcagttcctctgcaagcctgaggatgggcctgcccgacctgccgctaccagcacatctagcatccattgcatgtgccaactgcaggcctaaggaccggactgcccagccgggtgcagccaacaccaacactggccacttgggagccaggggatcctcctgccattgctactgccattgcctatgccacgcccattgcccagacgcccaaggaccctcccacccagcacactgatgccacctaccaccagcacccaagcaagccaactggatgcccaagaactgacatgcctagacttgctaacgtggatgccagtgtacacagccttgaggccaaggacaggcacatttagcccaccaccgccaccgtggggcccaaggactggtgcgcccggggtccctgtccccagcaaaatttcactgcagcttctgctaacaaccacaccacccagagccactgaggaaattatagacaccacggatgccgatacagccaaaaaagaaaaagaaaaaaaatcatatggagactacactaccgtgcgcacccagaaccaaaaccaaagtacccaaccaaggccggatgcggtggctcacgcctgtaatcccagcactttgggaggccaaggcggtggatcacttgaggtcaggagttcaagaccagcctggccaacatggtgaaaccctgtcttcactaaaaatacaaaaattagccaggcgtggtggcacacacctgtagtcccagatacttgagaggctgaggtggaagaatctcttgaacctgggaggcacaggttgcagtgagccaagattgtaccactggactccagcctgggcaacagagtgagaccctgtctccaaaaaaaagaaacccaccccccccacccccacccaaccaaccaagaaacaacaaattaaaaaacacagtgcccaacccaaacaccactatagacctatcttcaggaaaaatcctcccctgtgaatgcaaatttaaaaaactggaaggagcacaagtcactgtctgtggaagagaaagcgaaaaataaataaaacaatttaaaaatggataataaataaatggaagaagcaattgttagaccaggagtgcagacatcaatttaaggacacaagaaacatgacaaaagcaaggacatatgactaagaaatacattaattctccagcaacaggttccaaagaaaaagaaatttaaaacatttttattaagtagtaaaagaagcctgacctaatactgttaggtgaggttagccagaatcccccttacctggatatttcctcttggtaattttccatctaccgacccccacactgccccttggctaccaattcccacgtgcccacaatgtatttggagctgagcctaatctttctcccccagtgcaagacctggttgcagtggtccctgtacctatcgccatggtcctgtgctttaacaaacaggactgagtatttttttctgtaacagcaggatctgagtacaggttgttggtgtcaccacagccacactaggccctgaacgtctgaccaccccctgttcttggagcctcagtcactacacagattggctcgctctggccttcttgactcttaacattgcccagaaggattcaccaccactttcagcgtcatagttctttgctttcaccattccgagtcggtcgtcatagaatatgctatcatatgtcactcaaaatccaaaatatgcctccgatataaagttacactgcttatgccaagtcagtggtcttgccaaatgtggccatactctggaggtgactttgtgcacatatgttcccagtattttctatccatgctcagttaagcagtgccatttcccttggcacagagtttaaattagttatttgcaaacgtaaattcacatttctttttcacctatcacaccgctctctctaaataacagagtaaaaacacttacgcagataatttgggtagggaaactggggatggatttcacagtcattcatcattagcctgacaagtctttgagttagggattgaacactccggcatattagttggctatttgttattgagagcaccagctctcaagatcacaggacatataaggtaagtgatgaaggatacacaatggcatttagagaaactacacaagaactgaagaaaaacaaggaggcacattgtttctgcatcactcttattacctgcaaaccaggggatggataatttaaaataccagcggagtccacggcagccgacagcctgttaccttccttggttacagaaagatgcgggggtgaattacccactccatggctgctttaccgcgatgcacagtacacgtcagatctcttgaaaatactcgtcgtggctcactttgggaggctgaggcgggtggatcacgaggtcaggagatcgagaccatcctggctaacacggtgaaaccccatctctactaaaaatacaaaaaattagctgggcgaggtggtgcacgcctgtagtcccagctactcgggaggctgaggcaggagaatggcgtgaacccgggaggcagagcttgcagtgagccgagatcgcgcccctgcactccagcctgggtgacagagcgaggctctctctcaaaaaaaaaaaaaaacaattgccatgatatagtcaattcctacctcctacgagtctgactgtgctgcttgtgatctgaccaggagaactctccacttttcccctgtgttgtcctttttcataatccctgcttagtaatcacttccaccaagaagaaacgtctcaactttctcatgtgtgagattcaaccagtcaccctactcttcattattacaaacaaaaggtcaagttctccttttcttgagttatatacagatttaattagttatttctaataaaaaataaaattccacatgatcctttctttccctctagctttattttgcacaaatgctctcatttcccccctacatctaaatgcaaaacagaatatattcactaaaggaatcagggtttgatgattacagcaaacaactgcatttgcatatgtgaggtttccaactttgaattcaaagacaataaatagcaaaatgatttagattagaatttgccgtttctggaaaaaaaatgttatcaatgacaggaaaagaaatgttggtgtcaaagaaaataaaacagaaatacctgtaaataaagatgagtatctatcaattataccatgataaagctgggtgggagggagattattactgtaaaacttgtttgaaggggaaaaaattaaccaaagcattatcaataaacgactaaaaagctgaaacgtaaggatcactttgggaaatgaagcaaaatcaaacaccaggaaacaaggcatgaaaagaaaaggattaagggaacagatgagttgatgacaaaaaagttacaaagaccaggaggaaaaagaaatatgagaattaccgattgtaataaagaaaaagaaaaagactgacaagcataggaaaaaaaatgacgtttttatggctgcttgatgatagttcagtccattgtcaacctaactagaatcaatcagaaagccgatcctcagaagcaaatgagtgaagaggcctctgggtaaaggctgagagtactggttgatgggcatcactgttaccactgttctcacctaacttgagaagattgtgatactagctccccaaatgctcctgttaatggcatgtaccctactcttagcaggtctcacattctgtgcaaaaacactgaaagtcaacataatatgttttgtagtgtaatggagacagatcaggtttttactaagctaaaaggagatacagccttggctacgcactcgagcagaacgctgtgaaaacgcatactaaaatgatgagcctgaactccccacataccctcaagtgcatacagggttgtgtctctgcaaaagcctctacccattgaggtttccttgtgcaggggatagtctgtatctagatgctatatcaaggtgaagatcaagtatctttagttttcataaaatactagattccaaacagaaaggtaattatcagacagagtaggtggcaattagaggctgagcaggaggctctaagaatctaaaaggaatttggtcggcatgtgatcatgaaatccccaaaacattccagaaagtgataaaaataaacacctttgggtaaagtgttatttccccaaagaggaattgaagctagttagatctctttggtcataatatatattatcagtatatctggagaaagaaacaaagcaagattaccttttcttcttcttcttccatagtttaaatttgctacattgggaaacttcactgcacattaatatatcaactccaactagaccaaaatctttcaattaactaaaaacattttttaggatgtaactctgaaaaaaataaaaagtgagaaaaagcaaacataaagtaaactggcttaaaagtagggttcagtttgttttgttttgtttttgagacagagtctcgctctgtcacccaggctggagtgcagtggtgtgatctcggctcactgcaagctccgcctcctgggttcaagcaattctctgcctcagcatcctgagtagctgggattataggcgcctgacaccacgtctggctaattttttgtatttttagtacagacagggtttcaccatcttggccaggctgatcttgaactcctgacctcatgatacaccagccttgtcctcccaaagtgccgggatcacaggcatgagccaccgtgcctggccaagtagggttcagtttttaaaaataaacagcagcaacaacaaaaaccccacatgtactttcaaaagtatgttctgtgattactcttgtgcctggttcttcaaacaaacacaggacttttcacaaatgaagcctgcatgttcaatgctgaataagattaaaacgtgtttagctcattgtacctacagaaacacaacagaacttcagcaagattttcaacaatgattattttaattttaaaaaggattttgtgtaactttgtttaaatctgataatcctctttacttcaaaaaattaaagaagaaagtgaaagtaatacttggaagcaaaatgaaactaacacgaagtgtatcaggtacttttccacattaactcactgatgtaattaaattacaaatgctcagcgtcctaaggggtcaacactgtaattaggaaaagtgtatttctccttagtccttataccatttgccctggtataaatgcttgtagtaaacattgttactctttctcagacaagcgttttaaagatgctagttaaaatgtagttggtagctagtttcctgagtcaatatggcaattataccaataaaattgcagatcaagatgagccagaggcagtaaggaacaggccaaagaaaaacaggaagaaaaggggacgataaagaaagtggtaggccaggtgtggtggctcacacacctgtaatcttagcactttgggagactgaggcgggcagattacttgagcctagatgtttgagaccagcctgggcaacatggtgaaaccctgtctctacagaaaatgctaaaacattagccgagcatgctggcaggcaccagcagtcacagctactcaggaagctgaggtggaaggctcgcttgagcccccaggaagcaggggttgcagtgagccaatatagcaccactgcagccactgtccagccttggtgacacagcaagactgtcgcaaattaaattttaaaacagtggtagtttattccaaattcatgtgctaatcaaatcatatctctgtgccactctcacattcagccctttcttcccgtttccactgcaggtatttgtctcctgtattcattatctcttacttgcaactttccaagtcaatctctctggtccctgtctttttccaaaccattctttaaattgtcatcagataaatcttttttaaaaacagatttgattttacaaaagagaaacaggagatctacccagtagttgcagaataaagacaaaattctctcgtgtgacatcaaacgccccctataatctactcccatcctgtgtttccctgcacccaacacgtatttcagttatcctggcttctctgtcattcccaagtcaggttgtgggcccatgtggtgttttgtttttgtttttgtttgagtctcgctctgtcgcccaggctggactgcagtggcgcgatctcagctcactgcaagttccgcctcccgggttcacgccattctcctgcctcagcctcctgagtagctgggactacaggtgcccgccgccatacctggctaatttttttttgtattttttagtagagacggggtttcaccgcattagccaggatggtctcgatctcctgccttggcgtcccagagtgctgggattaccggcatgagccaccgcgcctggccgcccatgtggttttatgtcttttctttttttttggcatatgattgccaggtcatagcttttatatctttattcatagtttcctcttttaaaaatatctttttcactactgcgatcgctcataattttattcatcctttaggatccggcttaaatgtcacctccttcaagaaactttcctacatccaaatagatttacctgatacctgagtatagatagtacagtatattgttataattgttctattttagtattattgttgttaatctactgtgcctaagttataaattaaactttattgtaagtatgtatacataagaaaaaacagtatacatgaggttcagtactatccatggtgtcaggcaccctctggggtactggaatgtatcccccatggataaggaggcactaagcaacatattgtatgtttagctttgcatacttttggctacttacagatggaatcatactgcattgatgattttgcaatttgttttgggttttttttttttttggctcaacattatatcctaagattcatttatgttgatgcatgttgctatagtttatagctgacagacctcttgatgtgtcttctaggaggcgcttatgaagagaatttccataggaacactgtttgtaaatgcaaaaaattacaaatgaccctatgttcattactaggttatacaaatagataacattattttctattttttcatttttcagagatggggtctcattttgttgcccaggctggtctcaaactcctgggatcaagcaatcctcctgcctgggcctcccaaagtgttgggattataggcgtgagccacagtattcagcctcttggtattttctatactagcacctactaatgtatatggcacatagtatactctctacaataaatgctttttaagataaacgaatttgagaagaaaagttatgtctgattcattgtggcttcctcatccatagaggccagcacatgctcagatgctcagtcaagatctgatattcagccacaaaaggctagcagtggacaggcaggaaataatctgagctgacacaagtgagggagcaaaacaggacgtgtgacgtgttgggtgcctacccctagcgaggcaggcagagcattattttttatgaggttaattccacctgcttacttttgagtcctacaaaccactgtagttcacaagaattcctttcttctcttgtgactctctgtctccccagcctcagctaattccctctccctgtctttgtctccctccttctacttctcctcctcctcctgtactactcccctactcccctgggtatgagcctgcttcggtactctgggaagggtttagtgatggtggtaaaaactgacttcttgatttccttccttgcctgccagcgaagtcatcttccagcaacttcttccattctgttggagcaatgatttgtctctcactatgccatcctttggtttgaacattgcatacccatcttaaggcagttgatccaccctgcttattgcctttttggcatattggatgccagctcttgagcagaaccaaacccctggaaaactgatcaccatctcaacatcttattaaactaattctcattttgctaaactagaaacgaatcatcaggctaacactgccagtgaagatgcaatgtaagacaaattataccaaaccaccaataggcatgtattcatctgcagcaccagccaactactctcaaaagaactgatacagaaaatgatgaaaaggaattaaatccaaaagtaaagagacgactgccaactacagataagattttccatgaaattgagtattattcggttcatctcactctgacttcattttattacagtttagacctgactagctaaaaaaagaaagaccatcgctttgacacacaatagaagtaaaaataaagctgacatgtcaccctttccttcattcctgttttcaatattcaatcttccccctttccctttcccatcacctactacactcacttccactgtaacatttctttctcctctcttagaaaagatccttagaggaaattaaaatgtggccagtccttactctttaacgtcaacgtttctctcagcatgcacttctctaacttgagctatcatttcactaaaataactcaactctttcttttctgaatcttccctagcgttgctgtatttcttacacccgcttggattcatgcccactcgctgctcaggatatattgtgtctatacttgagtaggcacaaaatgctttttcaaacaaaacgtatctgtcatatcagtactgtttcctccatatacgtcaaccaaattaaatagcttccctgaccttttgtctactttctttgccttctgagtatcctcatcatctaactcttggcctggtaaaacaggatatgtggaaaagtcataacttaccttcctcattattttctctatcaagccataaaaagtaataagggaaacctttactttgggcttaccttcactccaaaatgtagaattgtgtggttaggtttaaaaaatgacagaattcttgcaagaaaatgttaatctaatgttagaactcctagcagacaaggtagggacgctgaatgtaattattcagagactttgagaaaaaaaaagcgggggggagaaacaagcgggttttctatctgcaatgagcccagcactttatgaggtgcctgtctagattctttttttaccacgaaagttgggagaagctactatcaccctcatttcacaaacgaggcttctaaggctcaaagaggcttaagtggtgccagatattgaatccaggtttttctgatcctcatgttccaaagcaggacaagttaaatctgaaagcatcttaagaggaatgagctataaaataacattctgacaatacaatcatacacgatgcagactgcttatccatgaaggcccttcacaatctggcctctgcatcctttcctcacccttcctctcatcaccggccacaaatctccctttttccagccctacagaacaccatacaccattttctaaagtgctgtgctgatgaatgtactttccacaggctctttcattcgtgtgactgccctttctcttgcttcatctatctcctactccaaaacttagctcaagggttgcctccttcaggaagcttttcctcattctccagtctgatttaggttctcctcctccgtagcaaagtacatacccctaacaataccacttaccccactgaaccatcattgctgatttacttgtctgtttcttttactactagggttattcctagaaagaagaagctacattttatcctactttgtatctctttcatatagtacagtgactgacacatcataggtgctccagaccccaaatagaagaactgggacagaaatcaaagggtagtatatctgggatcaccaccctgggggagtgggctatctcatgaaccagtatttaagcagaggctagataataactttcaggagcattaagaactcttttttgttgttgtttggtttttttgaaacagagtttcattccgtctcccaggctggagtttggtggcatgatctcagctcacttcaacctccgcctcccaggttcaagcgattttcacgtctcagcctcccaagtagttgggattataggcgtgtgccaccatgtccagctaattttttgggttttgtttttgtttttttaaggagagatggagtttctcaaaaaacaaacaaacaaacaaacaaaaaacaaacaaacaaactctggccaggttggtctcaaactcctggccttaagtgattgacctgcctcagcctcccaaagggctgggattacaggcatgagccaccatgcccggccaagagctctttacactaagtgaggagcagtgttaggcaagccaagacatccatgcttgctctgttattctacggctcccgacagctccagatcaaagttttctgatgaagatgggccaacatctcagaagacaggatggcacaacagtaacacaactatcatagttagaaaacctgggttctggctctgacttggttgtgtgatttttggtagacagtcccaaaagtcttgggtgatttcatctcagtttccctatttataaaacaaagggtgaaaggtaagctagggggagctgaccaactagatggtctgttaaacgccttccagtgctaagagaattgccttattttcccattgctcactgtgttctcttgtgaccacctgaaggtctctgccagctcatcttataccagtgctgtcttccctgtttgatggctcatttctctaaataaagcataacattcacagaacaaaatgagtaaaatctctgtttttttagttcactggacaacatcacttttcttttttcatttttgagacagggtcttgctctgttgcccaggctgtagtatggtagtgccgtcacagctcactgtggcctggacctcccaggctcaagtgattttcctacctcagcctcctgagtagctgagactgcaggtgtgtgccaccatgcccggctaactttttccattttctgtagagacaaggtttcatcatgttgcccaagctgctctcaaactcgtgactcaaatgatccaccagcctcagcctcccaaagtgctgggattacaggtgtgagccacatgtgctcggccacatatctttttattttaaaatattaataaaacaaaattatgcaggtaaactctgagtccaaagggaaattggcattgacttacaaaatttaatcagatacttagaattcactgagttaacacgtgcatacttgaccttgcttgatgcaaagatctgtgatatgtaatcatttgctacttcactgaagatgtttgaatcctccttgttgtaaggttgactccacaggaaaagactgattcacatggctttgttatcattggctttctgttatgaaagcagacaatttaggtcaagggacaacaatctatttttctgcctgaaaatgaccccgacatgaaaaccaactgatagattggttcatttctattaccagcactaaagaatgggcatagggctgggcacagtggctcacacctgtaatcccagcacttagaaggccgaggccagcctgggtaacatgggaaaacccccatctctacgaaaaaaagacacaaaaattagtcaggtgtggtagtgtgtgcctatagtcccagctactgaggaggctgaggtgggaggatcacttgagcctgggaggtggaggttgcagtgagctgagaccatgccactgcactccagcctgggtgacagaaaccagactctgtctctaaataaataaataaataaataaatggcataaattagccttataaattactttaatcctgaatttatagaatcgttacacatctagaggaattacttaactttttcagatatactttgcatttttcacagagagaaaaataattacataggcattttcacatttggaagttcataactccctcgggacctattccacaggaaggccgaaggccaaaggtctcttgtatattatctagctccttaaaatggcaacatttaaaaaaaaatctaacctccttctcccccaaatcaattcagtttgttgaaattcttccatatgccttaaaactaccaagggaaggcagagtcagacaaggtttaaatgtttgtaggcatctgagaaagaattgaaaacaatcagagtagagatggtggtctactctgcattctcccttgggcgctaccacaaaggcacttctctgtacccatcagcagagccgcacatgctctctcttctcatagaaacagggtcaaccctcatttctaggaacataattttcaaccacaaagttcccttccattttttactttcctgacatcagtctgctaagtgaagatatctcggtaagaactccaattttaaggggaatgaatctttacagaatgtactttatcttgtcagcactttgaatctaaatttccttctcaccctttcaccctaaaatatcagcttgcatcaggcacaaaggaagatgcacagctgcaagtgctcaagatgactaaggaaggaaaagcagacaagtcactaattactctccaaactggaggcctaaatcatccttctcttctacctgttgtttctggaatagtttatgtcagtaatggaaaatttaaacactgtcatataattccattttttttccccactccagctcttaaaaacatcctagatgttaagatgtgtagcctaggacagtggttttcacacagtgctctaaggaacctttagagccagacacacagaggaggtatcaataggaggggtctgatgccccttcgacacatgttactataattaacatgtattttgagactgagaatgtaggctccatgaaagccgggattcctgtttcctcacagccatcacctcgtccttttaacagggcccagaatacagtaagctgccggataaaagttttttgactgaataaactgcacggttattacagctgggaactgatttcgctgatttccacggtaaccctgtgaggcacgtatagtagttatcctcactttgcagatgggcaaactgaggctcagagcagcctggcttccaagaccctccttctaaacatcataccacatgacacagcctcccacgtgagccagcagctgtatttcatctgttttacatgtgaggtttcccaccatttgactggagaaaggtcgatgttaggggagaaaaaaccatttaaaaaccaccaacttcatggtgaaatccaaaggctgcaagtaatcaatctcactccttgctctgtttttcctgccacccttgggacttgacgcaagtggcttaactgctcattgtttcaggttcctcatcttattttacaacctatcttgcaagatgagtatacatgaaatattagaggatcctgatgttgtcagaagtgtagttttgcggatgttgatcccagaattgtgaaacaaggacacggttgagatgatcgctaaactctgcctgaagttcaacgcctctgtcattgaagaccttgcacagtgccgtccacatggttattttattcctccatgtccttaccaactaaacaagccatatgattttaggtttcgtggccagacagcctggctaagctcctatcaacatgtcagccagatgaggtgaagagatggagaaacaaacctgcatgtgggttgcgtcgaacaataaagagaaaacagagaccaaaaatcttgtgccaaggtttgacctcaacaaccgcaaaaccaatcattgctgtgttgtttcactatgtttctagaaacatccatagaggagaaaccaaagtcggcctgaatacatgttaatagctttcacgggcttacttctgatattttaaacaggcaacaaaaaagaaaaaccaagtttcagatcttgccagaaattggggtttcacttaactgtaaaacagtcaaggggagtttatcaggtaagacacgaagcctttctttataagctcttataagactagagaccactggattgccgtgcagttactgccgctggcattattttcttagcacactaagaaaaataaaaatgttcaaagtcctgtttttaaaaacaggatgagacttctggcttctgatctggtatgtaagaagcttagaagtcaccattccatcctaacaacaagtaaaaagctaaacaaactaaaaaatcaaccattcttcttacacatttgagatgctagatatattagcttaatttaattattccacattgtattaaaaactcacaataccactttgcatcttataaatatacacaactataatttctcaatatacagtgttaaaaaaaaattcttagatctgccaaagaaataaggtcacagggcaagctgctgcccccaagactagagagacagaggggcgcatacagagcattgcaacttactacaacagaaacctccatggaaatcagtacccggtagaaacctcaattgtactcgacatactgctgggggtctagaatgaacaactcttcgagtttaaaactccagaggtgcccatcatggggagtagggagggataagcttttgtgagtttttttttttccaggagctctagcagggcctcgcagtgagtatcagagaaaaattcccttatgcttccagtggaaaaaggaggaaaaggaccattttgaaaaaacaccagagatcagcaccataggaaaaggaaaaaagaaaaagaaaaaaacaccagagaattatgttcttaacaaggttttgccctccagagaaactaaccagaccctaacttgctggggctttggcagagcctaacctacctggggaaggaaaatacccaactccagtccactctagtcatcctgtcccacaagaaaacaaacaaacaaactgagaagcactgagtgaagctcacagtccagggtcatgggctcactagaagactgagacccactcacaggactacaggagaacaattccattctgagttagtccactttgcatttgctataaagacgtaaccaatgctggctaattttcaaagaaaagagatttatttggctcacggctctgcaggccatacatgaagcagagtgtaggcgtctgcttctgatgagggcctcaggaagttcaccatcatggcagaaggcaaagaggggccagcatgtcacatggtgatggagggagcaagaaaagggaaggagagccagactcttaacaaccagctcttgtgtgaactaacagagcaagaacctgctcatcaccaaggggaaggcaccacgccatgcatgaggggtccacccccatgatccaaaacctcccaccaggccccacctccaacactgggggtcatatttcaacataagcttcggaggggacaaaacatccaaacagtatcactccccagtgatttaccaccacatcactaaagacccattcacaattctttttacccagtacatcatgacatccgtctttcagcaaaaacttaccagacatactaaaaggcaaaaaacacagtgtgaaaagattgaacaagcatcagaatcatagtcagatacagcagaaatattggaatcattcgacaagaaaatttttgaaaatgatgaataagctaaaggctttaatgaaaaaaggacatgaaagaacagataagtataagcagatgaaaattctaagaaagcaaaagtaatgctagagatcaaaatcattttaacagacttgaataatccttttgaccaacttattaggagactgaacacaactgaggaaaaatctcagcttgaggatacgacaacagaaacttctgaaatgaaaaagcaaagagaacaaagattgtaaaaaaaaaaaaagaatatccaagaactgtaggacaactatgaaagatgtaacatacatataatgggaatattagaaagagaataaagagggaaaggaacagaagaaataatattcaaaacaataatgactgagaaattccccaaattaatgtcaaacaccaaaccacagatccatgaagcttagagaacactaagcaggatgccaggaaaactacctctgggcatatcatatttacaactaagaaaatcaaagataaagaaaaaaaatatttaaaaaaataccccagagggaagaagaacatacttcagtggaggtaaaagaaaaacttttgttttcttattcttaattgatcaacacacaatatctttttcaaaataatagcaacaatgtactcaattacgtatgcatatatatgcttatgtataagtgaaatgaatgacagtgatgattccaaagatgggagggaagaattgggaatattttgttattataagatatttgcactactgataaagcagtttcatgttattcgaaaatggacttggattagtagtaagtgtatattgcaaactctacggcaaccattttaaaaagtaaaaagaagtataattaatatgctaataaaggagagaaaacagtatcatataaaatccagctttattcataatttccaaaacttggaagcaaccaagatgtccttcagtaggtgaacaggtaaactgtggtacatctagacaacagattattcatcactaaacagagattagtcatcaagccatcaaaggacatggtagaaccttaaatgcatattactaagtgtaagaagccaatctgaaacactttatacggtatgatttcaactgtatgacattatggaaaaggcgaaagtatgaagatagtaaaaagatcaatggtggccagagatgagaggggagggagagatgaacaggtggaacatgaaagattttgggggcagtgaaaaaagtctgtatgacgctctaacagtgaagacatgccattctacatttgtgcaaactcacaggatgcacaacaccaagggtgagccctaatgtcaactcgggagtctgggagataatgtgtcaatgtaggttcatcgactttagcaaatgtaccaatctggtttgggatgtttatgatgatgggagataggggtggggcagggaatggccaagggttatatgggaaacctctatgctcaattctgctgtgaacataaaacggttctcaaataaaaagtttattaattttttaaaggatttttacacaactaagccttgataaacatttaccttctttcttcttcatcataattatttttccgcattattttgctattttccttctctccttctctctctctctttcttttagagacagggtctcactctgttgcccagcctgaagtacagtggtgccatcacagccaactgtaacctcgaattcctaggctcaagcaattctcctacctcagcctccccactagaactacagacgcctgccactatgcctggctaatgtttcagtttcttcgtagagatgaggtctcattatgtttcccaggctggtcttgaactcctggcctcaagaactcctcccaccttggcctcacaaagggccgggattacaggcgcacatcacgatgccagacccaattttgctattttctagcataacatggtatgcacacattaaattaaatgtgaaaaacaaaggcaaaaagaaaaataaatcaacaaaagttctccaatcatgactaaaatcatggactatttccttctaatcttttctacaggctgatttttaaaaacattacttaattcatggagaatatcaaccagagtgctcaagatctggcccttgggaagacaggctttcagatcatctcgagtccttatttcctttctacccccaacctctgctgtgcctggtgctcagggcccctctccagaaaccgtcactctgaagatgagcaggcacattcaaggctgtagggagtacaggggaggatctgatgcagtctttcaaatactccttttcttttaaggtccccatatgaacctatcccccctcaggacctcacttcattaatttctgagcctttctgagcaggaaatatgcttgcttctcatcgatatccaccactgtaggcactcagatcccacctagctccccactgttaattcagtcatcagaactccaactgctttttgtcttcattattgatcaatgtgttataatgacttttgattccatcaaaagtagaatttgtttttccattcctcattctccttgccattctatggtgatggatgatttctgagagaagaaagaggtagaaatctctctattccatcacaattcttattcttacatggtattgtaataccatattatctttattaatctggctttataatatatttcactgtctggcaggaacatggtcatttcaaatttgactgaatgtttcaaaaaagtattttctatttgtctttaaagttatgggcaacttaccagataagttgaaaagaagttcaatatcctaaattcaaaatcctaaattttcacatgtagaccttcctatcaactcagacaatgccaggcacaaacctatgatcagtaactgctgagtgattgtgaacaagccatccaagaaaagtcaaatgcataggggcatttgtggaagtgtggagttgtctctgaaaagctgttgcactgtgaacttgtttcagcctgagaggcaagaaaggctggcctgtgattacttccggtgtctacctagtgtgaaatgtgttgagtcaatgaagcatctggaacagacttagttcaactggaaggttcatgactgggatgcttcctggagccctcagaccagagggcagacataacccaagaattgcttcttattaaaggaacagagacaaaaacctaaacagagggataacggcagagcattaaatgcagataattccatttgcgactaatttacccaaataaaatagcagaaagcagctttcagtggaataatttaaggcaacaggcaggagagtggcgtgaactattattttcatatttccattgcttacttgtcacttccagtgaatatttaacttttgagcatccactttgtggcttaaggatgttcctaacttccccaaactttgcatccttgaccagtacactacaatatttattcacaaccctgggaaatacctatgggaaagttactgttccctgaacgaaatacatgaaaatccagatttctctactcgctgacagtttatatagataatgctacttccccctcaatttatctctactctgtttcaatctacacactgctgtcagaacagcgttagaccacagatctgagcactttaatccccccctcaaaaatggcccccctctgctcaccagctccatgctgaggctctcacgtccttctcatgatataacccccatctactgagacactcagttctcctcaaatgaatctattctccattccctgactaagctgcagcgttctcacctcagtgcctttgcctaggctgtgtcttccatctgaaatgccctttaccagactactggaatgacaactctccttcaaggcccaagtgcctcctatattaaaacaataatggttagaactttccatttcaacaaaatgatgcagaattcaccttatattgaaaaaggcaggtagtgaaggaaattcagtgtacgagtaacaatgcacctcatgtaaaccactgtgaggtaaagaaaaggcaaggactttaaagccagatattcatggatttagctccctggtctggcatctttgaatcttgtgactcggggcaagttactcaagtcttctggaactgagttttctcctctatacaatggacacaatggtacctgtgttgcaagtgtggactgtagacacaaaccacgcgtttcccatattccatttaataattctgtgctgccctcgtctttcccgcgttgtaaatttcagccttctcaggtctgtgtctttctcctgtgccgttcatcagtggaggcttagttcccagtgctggtggaagatgcctccgtacactgttaaggaggcaatgctttctcttcctatcattgataatattctgcatcatagggctatgagacctccaggcttcagagattaccactgtgtcctgtggaggcaacctctaaaaagtatgtaattctgattttcttagttaataatgtgtcactctggtaacactatttaaatgggtctctattttctcaaaacgtaagtacttctgagttctctttgttaagccagaaggggaggcaaaagaaaataactttgctagctttcttatttaaattgagagcctgggatcaatgaaaatcaacacgggtttgctgtgagaatgaaccacaataattaatgactcttcagtggctagaacataaaagatagctagtgttagtgagaccatcagcaacaatacaactgcacaacttctactaacaataatgacatggacactgttctgccagaccttccagtccacaggcctttgaggccttagccaagacttttctctactggaggggtaaaaaccactaagcaaagcctcgcttgtctgagtcagctgagtctcatagccagggtatttgtctgaccctgttttcagtgctgaatttgccatcctgttgtaaatcagtcagcacaaactcagaaacatacccgttcatttacttaacagcacacaatccttcaaagggcaaagtggtttgaggaaatccaaactaaccaaggggggaaaggccaggaacacggattcctctgctgaagataaatggtagctatcaaatctgcacacaaatccctgaataaataccaacagcattccttcgtgttgttttgaaattcaaactacattaggaaaagagaaaggtgccttactttttgacataccactaagtcttcactccatcagaatgctattagcattagtggcagattttattacctctctaagtgtgtataaaaaccaagtgtctctaaaaagtattatttttgttgacatttatcataaagactattaaaacaacatataaaaatgtcaatgttgactttcttcagagaaatagaaagaactacttaaatttcatatggagcccaaaaagagcccatatagctaagacaatcctaagcaaaaagaacaaagctggaggcatcatgctacctgacttcaaactgtactacaaggctacagcagccaaaacagcatggtactggtaccaaaacagacgtatagacgaatggaacagaacagaggcctcaggaataataccacacatctacaaccatctgatctttgacaaacctgacaaaaacaagcaatggggaaagaattccctatttaataaatggtgttggaaaactggctagccacatgtagaaaggggaaactggatcccttccttacaccttatacaaaaattaattcaagatggattaaagacttcaatgttaggcctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaaagtatcagaggaaacaggcaacctacagaatgggagaaaaattttgccatctatccatatgacaaagggctaatatccagaatctacaaggaacttaaatttacaagaaaaaaaacaaccccatcagaaagtgagtgaaggatatgaacagacacttctcaaaagaagacacttatgtggccaaaaattatgaaaaaagctcatcatcactggtcagagaaaagcaaatcaaaaccacagtgagataccatctcacaccagttagaatggtgatcattaaaaagtagggaaacaacaggtgctggagaggatgtggaaaaataggaacacttttacactactggtgggagtgtaaattagttcaaccattgtggaagacagtgtggtgattcctcaaggatctagaactagaattaccatttgacccagtgatcccattactgggtatatacccaaaggcttataaatcattctactataaagacacatgcacacatatgtttattgcggcactattcacaatagcaaagacttgcaaccaatctaaatgtccattagtgatagactagatacagaaaatgtggcacatatacaccacagaatactatgcagccataaaaaaggataagttcgtgtcctttgcagggacatggatgaagctggaaaccatcattctcagtaaactaacataggaaaagaaaaccaaacaccacatgttctcactcttaagtgggagttgcacaatgagaacacgtggacacagggagtggaacatcacacaccaaggcctgtctggaggtggggctaggggagagatagcattagaagaaatacctaatgtagatgacgggttgatgggtgcagcaaaccaccatggcacgtgtatacctatgtaacaaagctgcactgttctgcacacatatcccagaacttaaagtataattaaaaaaaaaaatcaatgtgtcatttgagtagctcattgcacccaaactggctattgcacaatttcagtttatacaatctattaagagaacgcacacgctctcgtctggttagaacgcattcttcttcctgagggaaaacctgagcttaggttgttctctctgaaacatccccactaacggggatgtcccttgaaggccgcagggactctaccttttatctctaaatctctggagcctaccttggtgcctggtacatagcagtcactcaattcatggttggtgggtttatttttttaaaaatagcagctgtcatttaaccagatgctgctttgtgggaggccctttgcttacatgatcactaacacttaaaacaactctgtgaaggaggctaacaaatcctgccttacagttgaggaatctcagatttaggaagattaagaaacttgtccacagctacatacctggtcagtgagtaaaagattcaaactccaaagcccagctttgcagagtctgaagcaaacactacgctgtacagagtctagtcacctatagtcactgctgatcttgccatgtctcgggcaccactgatgcctcactataactgaaccaagtgggaagggggcactgatctgaatgtattctgacaacagaccatgccctaggatgtaagtccctggtacaagactgttttcattattcttactcctgtctcctaaaagcaggcaagaaaaccagtttttgatagattagaattgcactctattttcattcggataccaagtcctgagacaccttagctggctaggtaagtctggtggtgggagacctgctcctgaagccataagcaagttaacatatgtgaatttcctctgtaaactccacatggctctatgacaacaacacagtgttcaatggtatcacggtggtgaaaagagcacagatttttaaatcagatataacagaattagaatctgcacctcccccttacaacctcatcatctagggcaagttgagttaattaacctctcaaatttctaattcatcatctggaaagtgtacagaataatctgcacattgcaggatgtggtgaatattgctaggtgttcaccaacatctgttctcccttgctcccagggcacaggcctgaactacgtttcccagttcctcccccaacccctggaatcaggcacagctacgtgactaagttcgctccaactgagtggaagtgaaagagttgggaactgcttctggagctaagccttgagactgtgggctggccctgctgggctcctttttccacttcttgtgaaggcctgaggggcggtggagcaacaccatggaaagaatccgggccctgaataacagcatggagtggagtcacccacccacctggtacatacattacacaatcagtgaaaaagaaataaatgtctatctcctttgaagctactcaattatcattatgtccctttgttacgagaacctggccttacctttgccaacagtgtttttcccacctattataatgcctggcacaaattgggtactcaataaataaatgatgtcattgctgctgctgttaccactactgccacacctaccatgcaaagcagttcccttcttacacacattgaaggttccacggccacagacacaaactgctgcccttagctacagaaaggaaagttaatgaaatgaagatggctctggaggaaaacaaaatcaaaactttcaactctagaagaaatagcttaaagcacatgccctattgaaggacaaacacttagctaaaacagccatcatcattgttgcttttgttaggtattatgtttttgaggttatagcaggaaagcttatagacacagcacaagaaggaaatttaggaaggcatataatcggggtgtccatgttatacacagggtgttcacccaatctgcaaatgtttattaaactattcaccaaatatttgtgaaaccaacgaggtaccaggtatttgctaaatggaggtacagataatagcctcaccctcaactttcacaggagttttatcacaaaaaaaatcaaatgaaaataagtagcttattgtgtacatgtgacaagggaaaaaggagaggaacaaaacctacccatgttgtgaggctgcacgagagagcaaacataccaaagaatcttgctttattttctcagcgaaaagagttctagtgcacccatcagttgctcttgtaaccagacactgtccaaggagcatcagaccatcccaactcaagaacaaatgtcccagttagccatggctaaagaacacttcccttaataacgtcttttgatcggcacgaggaaatctacctatatgagtacttttttggggggttcagtgagtcactcacagacctatttctcaccaagtcattcggaaacgtaaatgtccagaaaaataaattttaaatatgataggacttcctggatgttaaattcaatttcagagtattttctcatatgagagtcattttgtaaaatagacttttgcattttaacaaaatcatcatcattaatacctatgcttataggtctaaacagtttcaatcaagtcacaaactaaatcaggctgcccttcctccagaccctgacttgctaacagatgccactatctgttcaggcaccctcctttcctcttcccacctctctcaaagccactcccactgtgagtatcctcactctgacacttgtgtactggaagatgatttttcaatgagaaaaaatctctctttaaatgacatttttcaaatttaatatgactaagttctgcccccaaacctactccttagatgggaagattcattcccatctgagagatgacagtatttatttttctctaatacatgagcagtattataaaaccttcccccatttctccccaatccatgtcatccagtctatcagagtcatgacaattctgaccccagaatgtatcttgaatctatttcatttttcccatctcctacatctcctatgccaacctcctaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcctagggaaagccatcgtctccggcccagggaaagccatcgtctctggcctagggaaagccatcgtctctagcctagggaaagccatcgtctccggcccagggaaagccatcgtctccggcccagggaaagccatcgtctccggcccagggaaagccatcgtctctagcctagggaaagccatcgtctgtagcctagggaaagccatcgtctccggcccagggaaagccatcgtctccggcctagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcctagggaaagccatcgtctccggcccagggaaagccatcgtctctggcctagggaaagccatcgtctctagcctagggaaagccatcgtctccggcccagggaaagccatcgtctccggcccagggaaagccatcgtctccggcccagggaaagccatcgtctctagcctagggaaagccatcgtctgtagcctagggaaagccatcgtctccggcccagggaaagccatcgtctccggcctagggaaagccatcgtctccggcccagggaaagccatcgtctccggcccagggaaagccatcgtctccggcccagggaaagccatcgtctccggcccagggaaagccatcgtctccggcccagggaaagccatcgtctctagcctagggaaagccatcgtctgtagcctagggaaagccatcgtctccggcccagggaaagccatcgtctccggcccagggaaagccatcgtctccggcccagggaaagccatcgtctccggcccagggaaagccatcatctctagcctagggaaagccatcgtctgtagcctagggaaagccatcgtctccggcccagggaaagccatcgtctccggcctagggaaagccatcgtctctagcctagggaaagccatcgtctctagcctagggaaagccatcgtctctagcctagggaaagccatcgtctccggcccagggaaagccatcgtctctagcccagggaaagccatcgtctccggcccagggaaagccatcgtctccggcccagggaaagccatcgtctccggcccagggaaagccatcgtctccggcccagggaaagccatcgtctctagcccagggaaagccatcgtctccggcccagggaaagccatcgtctctagcccagggaaagccatcgtctctagcccagggaaagccatcgtctctagcccagggaaagccatcgtctctagcccagggaaagccatcgtctctagcccagggaaagccatcgtctctagcccagggaaagccatcgtctctagcctagggaaagccatcgtctccggcccagggaaagccatcgtctccggcccagggaaagccatcgtctccggcccagggaaagccatcgtctctagcccagggaaagccatcgtctctagcctagggaaagccatcgtctccggcccagggaaagccatcgtctccagcccagggaaagccatcgtctccggcccagggaaagccatcgtctctagcccagggaaagccatcgtctccagcccagggaaagccatcgtctccggcccagggaaagccatcgtctctagcccagggaaagccatcgtctccagcccagggaaagccatcgtctccggcctagggaaagccatcgtctctagcccagggaaagccatcgtctctagcctagggaaagccatcgtctctagcctagggaaagccatcgtctctagcctagggaaagccatcgtctccggcccagggaaagccatcgtctctagcctagggaaagccatcgtctctagcctagggaaagccatcgtctctagcctagggaaagccatcgtctccggcccagggaaagccatcgtctctagcccagggaaagccatcgtctctagcccagggaaagccatcgtctccggcccagggaaagccatcgtctctagcctatgttattgtgacactcttaacctcatctcatgcttgaccccttgaatccattctctatatacttctctagacagaattagaatcatctttttacaaacatgaaggattcagtcacacccacatttcaaacatttcaatggttttctgctacttcagaagaaaattgaaacttcttcaaatggcctaacacggctccgcttgatccagcctctaccacacaacagccatccccactcttctagccttgctccctcatggcatggctttaaatgccaccattggaggaagtccatccttaatcacaaaaccgaaaggaggggccacgcacggtggctcacacctgtaatcccagcactttgggaggctgaggcaggcagatcacttgaggccacgagcttgagaccagcctgggcaacatggtgaaacctcgtctctactagaaatacaaaaattagccaggtgtggtggtgcatgcctgtaatcccagctactctggaggctgaggcaggagaattacatgaacccaggaggtggaggttgcagtgagccgagatcgtgccactgcattccagcctgggtgacggagtgagactgtctcagaaaacaaaaaacaaaaaaccccaaaacttaaaagattctcccttgcatgagaatcttatttgccctccacttaccaccatttataataattcctctttttgtttccttcctgccctgttattaacacctctgaaggttggccccatgcagggaacatactacttttatagtgcactcggctggcaagcagtctttcttactttctctgtgttgtgtctatgtatacacagcatatctgtgagggagatattaatattattcccattttacagataaagaagatgtgaagcatatggaggctaagcccctccctccatcaggccacagagccaggtgcaagcccagtctcaccccagcatcctggctcctgtcagctgtcgtttatcatcactatacaccagcacgcctggctctttgtaggagctgagtgaacatgggcagaaggaatcgtgaagtaaacgcttccaagtcggaacatccagagacatttggttcctctctaggtgctcttacccattcctagttctactatttatgctgggaggcatcttctgtcccttactaattgataagttcatctagggcaagaatcatgatttatccatcttcgtgcctctcatgatacccaacagtaggcgctcaaaaaacttttcctagtgtgtgcaggcatttaaaactcagtagaaattaaccacaattgcaatgaagtaaaattcaactaagagttcccacaaaaaataagtacaacagtcaccattccagtcatttatagagctgatctgaatccagaggtaagtttccagaattaaagagctgttttatagactgcgtctttctacttcacgagtgggtagaaatcatctttattagaaaaaaaataagtgcgggagggcggggggcagagagaactatttcaaaaggtttttccctgtttgtcctaaatcctccagagcaggcagttaaacgttgagtccagcgtttcggagcctggccagtctattacaggccttggtggtgaaaggcagagtggcctcatccaagctttgtctctcgtcagcaatgctacctgtgctggcctttccgccttacttcccaaactcctctcccatttctcatttctgctcccatttccccttgttccctccaacactacgaaggcaaattatggggctcaatactgagaagtcctttccaccttattgataatgaatttctttcctgggaaacacctgggaaagagaccaaaaattcaggacagtacagcctaatctgaggtatctgtccattcttggcaggtatgcattgctaaaagcatgtgactactaccgtatatcagagagcccttttatggaacgtggctctctgctccatgagtgggtggaaataatatttagtgaaaagaagagtctcggcatcttaatgaaagaaacctagataggagatgagtcatttaaaccctctctctgtcatcacacagaaatagcttgaagaaagaaggagtcaactcaaatgcccaaggagggcaatggcaacagagatttgggaatcttttccagggtaaaaacaactgggatgggctaggggtgaataaggaagttccatcctgtctaaaggtgtctgttatggggtgaattatgttccctccaataagattatgttgaagtcttaacccccagtaccctaaaatgtgaccttatttggaaataaagtcactgtagatagaatgagttaggaaaagatcacactagagagtaagtaggcccgaaattcaacatgactggcatcccagtaagaaggtggccatgagaagacagacacaaggagagttccacatgaagacgggggcagagactggggtgatgcaggtacaagcagggaacaccaaggacagcctgctgccaccaggagctacgggaaagaaacggaacagtctgcctcagaaggagctcaccctgcccacacgccctgatttcagacctttaccctcagaattgtgaaaaaaattttgttgttttaagctaccctgtttgtggtatgtcaccatggccgttttaagaatcgaatacagcatcccaattcagacttaaaaaacgcaagatgaccaaacccagccccggcagctagatggtctctaattccaatgctcactattcagtgggcagtcacatttctgtcaaaaacaaaaatgcagttacaaaacattttctggctaaacaatgcattctcctggatctcacacatcagaattatcttccagatcccaggggtgagaagcgcagcttctgcgtcagacaccagtctagtggacatcgcacgctagccctgccactcgccagctgtggggctttgggagctctgtgcctcagtctcctccacctataagtgggaatgatagtgaagtcggcctcacagatgaggatgcagggcacactgggaagcctgctgaattacaacgagggggagaactcagcaacccaagcggcatgatctctatcacaggctgcagcactggattttaccttactgtgcatgatttttcatttgctttactgtgaactcacctaggacggggtccaggccttggtcacttttgctctccttgcacatgtgtggcaggtagtcagacatgcctcgggaatgaaggcaggaatgtacttcatcgactccactcctgtgatgtgagatccctgagggcaggacccaagtcctacatcaaccctagagcccagcaccaggtaagaggccacacagagggcaacgaagtcattgtgttggaaggacgtctgtagatgtattgctcaactctgccaagctagcatgggagcaggaattaaatgcttcattccagtttcaaggtctgagtttgtctgtttcctttctgcttatcacacacatgacatgtagaacaaattagggtgatgcttcctcactgaggctttttgggaaacctattaaaccaaggtggaaaaaataattcaagaacatgacaaatgcagctgtcagtaactctgcaacaggcagcaaatgctgagaaatgcacttattctctatggctgccgacgttgactggaaagctgctttgcagtctgggaaacaaatccctactccagactgtatgatatggattctgtctcagtggattggcattgtctagactagcagtcaacaaactacagcccatggtacctcggccactgtttttgtaaatcaagttttgttggtactcgtccctgcctttccagttatgtattgcttatggctgcttttgagctacaaggcagagtaaagcagttctaagaaagacggtatagcccagaaagcctaaatcattcactatctgaccctttagagagaggtctgttgatccctaacttggagtatcccactgtgattacacttaaaattaagcttgaagaggacagaaaccttgtttatctgggtcagacctatctagacgatgacctacctgatttatagtaggtgctcaataagtctgcaaagaataaacatgaggccaaataaatattgaggttttaggacaggtagtgccaacagcacacagtgctaaggggatgcctgctgggctagaccagtgtcccgaagctctgccctttttgagaggatgaggatctgccactgctgggtgtcccttggttaactagctacctgagagccctctgggagccctgggctgcacagacaaccaggacatcttcattttaagaattcaatagcattgagctgtcaggacagattaaacctgactaagaagaacctttcagaatccttctatgtatatacatttacattagaaatgttttaaaggaataaacacttgcaaagcggtttaaatttaaaggttcccttatacaactgaacccaaaacagctgtcagaaaccaaacatttataaatacaaatgctcaaggtaccaagtgaaaaaaagatttttagatctaaaagaaaaagtccaatctatcctgccataacaaaagcaaagaaggaaacagaaaagccagactttctgagaatgatcctttaatgttaatactgaaagcatgtgtaagttctggctccaataaagttgtttatggttagagttaagtaagaaggggtcctttaacttgggaaacgattacatagaacttgttgcagaaagaaagaattccatactatttctctttttctattttgtcctctcaaagaactgttgcttccatgcatcaggtcttcaaaccaggcttgggcaggcgagtctcccagccctccctccagcctggctctgggtgcagacccacggtcatggggaccttgagcacgtggggtcttcttttaggagggtttgtggaactgtagctctttacatagcccagagacattctccctttaaagtttttgggtaatgctcaattccatctttaaagaggtgggagttttaatagcacagctgtaatagaatcacatttcgagtttttgagacaggatcttgttctgtcacccaggctggagtgcggtagcatgatcacagctcattgcagcctccaccttctgggcttaagtgatcctctggtctcagcctctggagtaactgggaccagcatgagccactgcagctggctaatagttttttgtagagatgaagtctcactatgttgcccaggctggtctcaaactcctgggttcaaacaagtgtcctacctgggcttcccaaagtgctgggattacagatgtcagtcactacatctgtcccacatttatatttaaatagaagtagcatcctatagtctcaatttctgatcaaatgtgaaacaatcaaaatgtcagtctgagagttgatctaatataatagtaaaggctcacttataggctaaatacttccatcaaataaatcttaaagtaacattttctaattcaggttttgttttgttttttactaatccccttctaaacccacttaatttgtatttaattcatattcccaataataaaatcaaggaactacggaaacattgcatattccactaaactgtgtttacaatattaacaaaatctatttactccatagaataagcaaaaactcagacaagaattgactcactgggttcgctttgaggactgttatattccatttagaggtaggatttccttatttctttcgtagccacacctttggagatgtggccaagcattctttacacgaaacaagaaacacttgcaaagcggttcaaattcaaaggttcccttatacagttgaatccaagactgctgtcagaaaccaaacatttatcaacgcaaatgctcaaggtactgagtggaaaaaaggttcttagatctaaaaagtccaatctacccttccatagcaaggagctggggctctgcatgatggtagatgacttccaacgtgatctttccccccatgctaccagctgagaagacctcatactgaaggtcttcacagagacaagatgcctcatctccctggccttattttgtggcagctttcgggacattgttttcagttataacttttcagactctttcaccccatgggggttgtgttcccatattagaattaatataaatgcattttcatcaaaaggaaagaaaatagaaaaagaaaattaatgactagttacagcaaattcattatttcccctaaaaactaaacacatcaaaatgctgcttctttatccaaattcttcaccatattgaaatcatgaaatgaaacgacaaccagctttcatgaccagctaagaaacgcatttgatgagatcaaaagtccagcacgtggccccctgggacccacgaccagatgcccatggcagatttttaaattgtttgacttttcttcttaaaaatctacgtcctgttttgctgttgttcatttcaaacctcctgtgtgggagtgttaataaaatctaacatctgtaaatttctcatattggtttgatgaatccttgctcaaacattctcctttattctggctctaaatgatgtgatctcagccatctcctgaaagtatccaaagattaagacaaagatttaaaagccccattgaaaccacaaacaaaaagcccctgaacacctcaagactgagtctcccaacacaggctatgatggaatcgtttcggtttcaaggaatcagtagcaagaagaacagtcagctcctgctgagaaagggccaggaggaagagtgtaatgagggagagaataaaggtatgcttcagcttaaaactaatcatattataggtcaattagaatgcaacatttccaaaaccttaaatgtgtatttcatttgagtaaactcaatcaagtctactctttttttttttttttttttaaatggagtttcgctcttgttgcccaggctggagtgcaatggcgcggtctcggctcactgcaacctctgccttctgggttcaagcgattctcctgcctcagccacccaagtagctgggattacaggcgcctgccaccacgcccgggtaatttttgcatttttagaaacagggtttcaccatgtcacccaggctggtttcaaactcctgacctcaggtgatccgtcccgccttggcctgcccatgtgctgggattacaggcataagctactgacccagcccaaccctactctcatctcaggattcaatggacaaaactgcttcctagttcaaaaagaaaaagtatgtcatcaggaacaaagcccatcaacttcacaaccatgcagcacaaatctatttgtgcctgcgcccgcagaagcacctcccctcctgtgcaagggcatgtgcactcacctgggccctggatcccactgttcctcttcatctaggacaggagctctccagcttgagtgtgcgtgagaatcacccagaaggctcattgaaacacaggctgctgagctccaaacccagagtttctaattgagtaatctgaagtaaggactggtaatttactttgctaacaatttccaggtgatgttttatgatcccagagcagactctgagaacaactaatctaagacctgctacactgattatcctctcatcctacatttttgagtctctcctttcatattgcttctttccctaagcatataaacatgttcaaatttgtcatcttaaaacataaacaaaagtctccctgacctccctgggaatgtagtgtatttctctttccttctgtacacatgtaggttcttaagagaatgttctccatacaccacttccatccgacttctccttgctctgtaatctatttgccctctcaactctgctgaatgtgcacatctcacgaccccacatgaacttaacagtttccaggccaatggatacttcttaagtccctgtttgactctctgccttacctaccatcgctcacctgaccacacagcattccctcctcccttggattttataacctctccctatcctggatctcctaccacctccttcactgcctcccttttggtctcccgtcctggaatatctgcttttcaccatccctataagtgctggggatcccttgggacctgtccttggctctcgtcttctgatgccatacattttgcctgagagttctcatccatgcctgtctttcacctataatctatatcctaatggctctcaaatctagacttctcttctaaacttcaactacatagaatgatcatcaattagacaattatatttgtccaataggcatctcaaagttatcaatacttaaaagtgaacccattaatttctaccttgttcctgttccccttcctttattttttacctaacaaaatggctcctccaactgctcactcatgcaaaccacctttatgtccttaaggaaaaacatgtccttacgtctcaagcacaatcacagttcagaggtgggtccaatccacctcttaactgtctcaaatctgctcccttattcccgtctccaagactgttgctccaacttcggtcaacatcataatacttggttcttccctttcttaactgcatttctagtcacctccttctcatattttaagctccaataacaccaaaaactagttaatgatatctttgaatgtggcatgctctcttacaatggaaaacttctatatattttattccctctgcttggaaaattattaaaatccctgcaccaacatgttctttccaaaaccttcccaaatgttcttgactttggactcctttctggctctcattccacttgaaacctgcctccattacagcaattacctgtttccaagcctaacactgcgccattcaaaggtaaatccttgaattcctagtgctgataatacctggctcaaaataggagccctactaaaaagtacttttatacaacatacatcagtgattctgaacaaggaaacacactcccctggcagtagagtaagcgagtctaccaaacattttaggatcgtttttagcgtttaattctcctcctacagaattttagataactaacatcacatttatttcatctcaactttaacatgtttcatctcttgtttacttcatttcttcaaggaactgagagaggacccactgaaattcagtttggggatgttaggaacctgttggaagattttctggagaagttttctcattacaacagtgtttcctttctagtcattagaagaatgaagggagctgagggaagcagatacttgagagttttacattttctgtacctcagtttgttctctaccatttcagtaaaagacagctactcccaaatacatttttgctgtatgcaactgtgctgttattcctgtagctggtccaagttttatagattactcacacagccccctagtgagcccagctgcttttatactattatgatgccataaacaaaattacataacattttaaggccagtaataaatgcctgaactagctgactggaacatgtagcatttgggcattttcatggtcttcagtgacggttttactgccctgaaaagccctccctgtacgttatcaaagaacaggaagtctccatgtctccactctcggttgttccagcctaaaggtgacccacccacgcccacatgcaaggctggcaagaacgggtcatcgtcaaagagaatatgctaagtgcattgaaacaggctgtgtacaaccttcatcaagcttcaagtagttaaaatcgtgccttacaagtatttttaaagaaaactggtataggtggatacagcaaataaacatgtatttgaaaatccagagacaaatataagtaaaacttgatgaacatatttgcattttatgtaaatgtcaatgtacatgttgtggaacaacttggctctctgctggagagcatacctccttttaaatgagtcaccacttgcggatgaataggaaaacgctgacagatccatgcgagataaaacggatcacagcagtcttggaatcaacacacttttatgatgaaaccaactcatattcatgcctccaaacacagcttaggcttgaaaccaagttgcagaacgtccaaaaattcttgaagaatccagatgttcccataatcagccactgatcaatttcccaggagaaaaggacttaaacaaggatgggaaattccaagacgtttaatacccagaggatatctgcacccagagaaatgtcacactcagaccacaggaagctatagctctgctgttgactgatgtagtcaggtgtctagaattttatgccagcctctacccactacacaccattactgttttgagataaattagcaaacaccaaaaattagaggtaaaaaagatctagaaaaaaaacaattgaaacgaactaaagaagccagagccagggaggtttaacaatcattagtaacaggtgatatccactgaaacttttccatgttcttccagcttcacgctaagaacttcacgttttcttaacttattcctcacaacgatttttaatttaaattgattattcccactttataaatatgaaaactaagacttagcaatattaagagatttacccaaggcacacgacttatcaacagtggagacggaatctgaactcagtctttctgattccaaagtcccggcacttaagcaccacactggagcctgaagcaaaggctcatgggtgaccccagtcttaaacatctgagggtttgtaacatggaagacagaacagcttcgttgtattctaaagcaggagtcctccaaacctgtttgtactggagaatcatctctgaaacttaaaaagaaaaaagaaaatccagtttctacggtcccactcacagactctgcttcagctgatctggcatggaggccagaaaactgtatttttataatgctctgctgggtttgagaatcaccgctccatacctcagaactagaataaacgcagaggaatcactaggaggcaggtttggctttacgttattaaacagacaaaccaaaccaaacacacacacacacacacacacacacacacacaccgccacccacaaaccagtcctaaccacagggctacacaagcctcccctgcccagtcctaaccaacagagcttcccaaatggagctgtagctgcctgctcaagcgccacgatataatggagacaacccagtctctggaaacagaggctgccatttccagttctgattcagccattctcaggtgtgtagctctggtcaagttattttctctgagtctcagtttgctcaactggaaattattggagaacacttacctcaaagaattgttaagaattagagacaattaggtaaaattcaaagaaccgtggctgatgtggctgatggtgctcataagcaaacggcacctgcccacttgaaatgtaaccatcttcttctgtagcttctgtagcgagcctctgcatgtggacagcgtgggccgcctctgcagcacccttccccttattcccaccattgtcccacccactgacatggccacgtcctattggcttcaagcccagattttagcaatgggctctgactggcctaatccaatcagcccacacctggcccccttgccacagccataggcagggaccagagcccaggccaatcagcagatggtgttcctctggcagagaacggtttgggaggaggctgagcatgtgtccaaaattgggccaatcagagtgaactcaaaggctttttttgtcagtaggaggaaagggagtatctcctcttccagaatgtatgacacatcagcctgagagctgacgctcagcagccattctgctaccaagagcctttatcaaactatgtctgaagcctgggctatctccatatttttgagatctgtgaaccaataaattccccgtatcatattatttaagccttgaggttgtttttctatggccaaggctgaacacattgtaacttatccagaatcccctggctgggagtggtgagatgtaaccacttagatcatttctaacttcatgattccatgacttcttagactttatccaattaatacctgtcttcacatttataacacttctgacgactggtttctgcagcctggaacatcctgtccccctttctcttcttaagaaatcctgctcaccttttaggacccaactgaaatgggtccactgctgcaagatctttgaagaggagtcagttaatccatcttcctgtgcactcccccagtacttgaccatttcctctcttatccttaatttcattgtgtacttttctcactcctatcttcacctatgtttaggctgtgtgcactttgaagacaacacccccttccctaggcattacttgttaacaggccaactgtgcagcaaagtagcacaaatccagcttgctgcacatgtccaatgcctaagatgaggctgggcctgcagcaggcttgcaagaaacaaccactcattcattcaatgccacatgagtggttaactggatacaaaggagaagcaaacacaacgaaggcttctgccttaaccttctaggtgtcctaccttgtaccttgaagggattagagagaaaaacattctccatcttgcactgctgatttccaatgacaagtggggcttcccccctcccacagaggattacaggccaacttgggtatggtagggttttggggactggaggtggtttagagttttttccaatcttattaaacttactcagagcttaacatctattaatgaaattatgttttctataataaaagtagagactcaaatcctatagatgccctgaccttaagatataaaaattcaattttaaaaaatattacacataccaaatacaaaagatctattctgtgacctcttctctaacaccaacaactgtaaatttaatatcatcctgtgttacctgaggtagttggaaggtgtttcttctacgtttgttgtatctagctttttcttttcagattttattatttatttatttttgagacagggcctcagtctgtggctcccaagctggagtgcagtggtgtgatcatggctcactgcaaccttgacttcctgggctaaagtgatcctcccgcctcatcgtcctgagtagctgggaccacagggatgtagctgggactacaggcctgcaccaccacacctggacaattttttattttttgtaaagacagggtctcactatgttgcccaggttagtctcaaactcctgggctcaagcaatcctcccgcctgggcatcccaaagtgctgggattataggcatgagccaccatgcctggccagctttttctttaagtgagaaaaatggtgagagagaactgtctcctactcctacttccttttggtcacacagctatctcgaccttgaataaaatttctggatctgacatggtttcagtggctgcaatgagaaaggaagtatacagcacaaactaggagtagatttgttattcatactccaacacctgattaccttctcaaaaaccagggtatttcctgcaacccagattcctcattgacaggaatcatcttggtctgaaggaagggatcaggagccaagaaataagagtggcctctagaagctggaaaaggcaaggaagcagattctccctagagtgtccagaaggagccggccctgccaacaatcttgaattttagtccagtgggactcatgtcggactttggacctacagagctgtaagataacacgtgtgtggtttttaaagccattgatttgtggtaatttgttatgacagaaacagaaagtgagtgcactgacttccctgtaccagtgaccactaactggcatctacactagtccctttccaaacagtagtgctgtttaaaaaaattgttatgtttatcaacatgaagcatcataagaagtcacaatcgtaagttgaagtcaattagaaaaaagaaaattctaacaattaccaaagatccaaacaagaaaaattcagtatcaaacattcctcttatattcacaaaagagacctgaatacacacatgctttaactaaaatgatttctttcctatatgtggaaaaaatgcacttattcattaattcaacacataatttacagagcctctcccacctgccaggcactgtgaagaatcctgagggtttcctgccatctatctgagccagggcaggtgtggaaaaaaattttcacattagttcattaatggtaaaataggaaaaaggaatagagccacagcttaaaagttatgtcgttatagacagagataccagcagagaactaagccacgtgcatttgttatctgtttctgagcagcttaaagcaaccagctaagtgacttcacacagttctgagggtcaggaatccaggagtgtcttagctgccatggttccgcctcagggtgtttcaggaggttgcagtcaaactgtcagccagagccacagtcaactcaaagatggacaaaggctggggcatctaagctcactcctgtggttgctggggaacctcagtcactccccggctgtttgccaggggcttgggttacttgccaggagggcttccccttagagctgctacaagaaggcaggtggcttcttcccaagtgacccgagagagagattctgaccaaaacagaagccaatgtgttttacaactgaaccccagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggtcacacacaccaactgtgatgcagtgtgggaggggagtgcccaagggtgtgaacctcgggatgcaggaatcattgggatcaggttgaagcctgactaccacaccatgttcttccaaaacatttcaacaaaggagccatgtagtaaaatcagcatggttctagaatggcagtcatggggcctggagtagccatggatcggccacttctagaatggcggtcatggggcctggagtggtcatggatcggccacttctagaatggcggtcatggggcctggagtggtcatggatcgcccacttctagaatggcggtcatggggcctggagtggtcatggatcggccacttctagaatggcggtcatggggcctggagtggtcatggatcgcccacttctagaatggcggtcatggggcctggagtggtcatggatcggccacttctagaatggcggtcatggggcctggagtggtcatggatcggccacttctagaatggcggtcatggggcctggagtggtcatggatcggccacttctagaatggcggtcatggggcctggagtggtcatggatcggccacttctagaatggcggtcatggggcctggagtggtcatggatcggccacttctagaatggcggtcatggggcctggagtggtcatggatcagctactctacaatctatcaaggcctcggtttccaaagccgcaaaatgacaatggagtcccatctattaataaaactttgggaggtagaagggctgctgcttctgcactcaacgtttactgggtgttcatcatgttccagatactgtttgaagcgttacacccttattaactcactttcttctcatcataaccctctgaggtggttacaatgttcactgctgtgtaagagctgagaagactgaagcaaagagagttcatccatttgccaaagcctcaccattagtaagaggtagtcaggattcgaacctaagtggtttggcatctaagtccacattataacccactgtactctctaacagagggtatggaaatgatgcaagtcagtacactataaaatcatcagcaatactaaactttaaaagaagaaaccacgtttaaaaaattggttaaaaaataggagccaagcatggtggtgctcacctataatcgcagctactagagaggctgaggtgggaggatcacttgagcccacgagttcaagaccaggctaggcaacatagcaagacgttgtctcaaaaaaaaaaaagatagatagatagatagatagatagatagatagatagatagatagatagatagacagacagacagacagacagacagacagacagatatagattccatttacatgagggacctagagtggtcaaacttataaagacagagggatggatgccagggctgggggaatagggaatggggagttaaaatttaatgggcattgaattttagtttgagatattgaaaaagttcgggggatggatggtggtgatggtttcacaacagtgggaatgtatttaatgtcactgaactatacacttaaatgatttaaatggtcatttttatgttatgtatatcttaccaccataaaaagaagacattaaactacaatatccaatattccatccaggggcttcctcaaaatggaaaatccccatggttaatcgctttagatgcatagaaaatcgttccgttctaaggtgtaggaagaaatccaaaaggacttgtcttttctggttggtccatcatcgctctctcaacttcttttcattgcacttttcattacagaaataaaataaaatgtcggaagagtttctgttactcttatctttcccaagtcacattaagtaggaatttttaatttaagtgcattccatttctaaagccaggaaaatctgcccacacgaggtgcttcatagcatacacattaggaactcctctatggttctcattatttacacccttcctcggatgtgccctgtgtgttttgagagtcagagattggcccgacaaaatgaaagcgaaggcgtcagctgagagggacgcggggctttaggtaaaggacacacgatgagaggccctggccatcgggttactgttgtccacgtgtcggatggctagagacgctgtgagagttactctctctagaggtcagcactttggatgccctcaccctctgaaataagcattttctcccgggacatcaaggagctggggactccaagcattttcctcaccactctggtcatctcccacatttaggaggaaagttctacttccatgaggcctttgcttgcctcatttcagaaataggggagggccttctcataaaatgactttttatgccttagttaagagcatatgtttaatttaccactcacttccctctcattatccatctatgtgcggatcacagtactaggtggtatgaagtgagactgagaaagtaagagatgaagaaacttaaaaaaaaaaagctgtaaaaaggacacaggtaaaatctaaccttcggctgggcgcagtggctcacgcctgtaattccagcactttgggaggccgaggtgggtggatcacaaggtcaagagattgagaccatcctggccaacatggtgaaaccctgtctctactaaaaatataaaaattagctgagggtggtggcatgcgcctgtagtccaagctacccgggaggtggagcttgcagtgagccgagattgcgccactgcactccagcctggtgacagagcaagactccgtctcaaaaaaaagaaaaagaaaatctaaccttcgaagaaatggaatgattaagacacatgaataaataaaacaccacttacctagaagtttctaatgtccagtaaacaaattgtcatgcttgttaaagttacatatcacaggtggcttcataagcctcaggacaacctgagaagcagccctgtgctacacggaagtcatgggactagagtagaaacaactaggtccaaaccctgaattccgcattaattcatttgttgattacgacgtccacccatatgacaagtatttagcctaagtctgtttatacacctgagaaatggagaacagtaacaaatgcctgagggtgctataaggattaaacaggtaatttatgccaacgtgtttggtaaatatttacagatgatacaattatgaactgtagggctggatgatatttcaagatatcaatttgtgctcttctctttgcattgcctttctttttctcccacagatcagactctgctcagtgcctcaggggaggcatgtggcagtagagaaagcagaaaccatctgcaaaatctgggatgcagtagggggtgggggagagactaatgcagcctgcagggctgacggagcaggggcctaggccccagttctaagcagggctgccacccagaagcacaacttccccaggagggggatttggatagacagagacacatgcaactcctgagtcctatgtgtggcaaggatgcatcagagagccaatagacatgcacagggggcaggccaagagagccatgcccctaacagcttggtcctggggatgagcccagaaccctgagaagggagatgaagttttccaccacaccagtggaaagacaatcagccagaaattgggcagatgtatagaaaaaaaaatgaaatgttatttttggcacattagagtttggggactgagttttatacccattataatatttaacttcccaacacctaaaatcctcctggcagttaacaacgaatgcccaatggaagaaatgtttcttgtttaatttcataaatacatatagagaagccatcttctctgactaaaaagaccacagattgtgctgctctaatgaaaagagcattggcagggcataaattctgaaacgattttctatatgttgctagccacatagaggatgctaaataaaaagctgttggctgatgggtgacaaattgtccagggcagctcataacttccctagactcttgagatcaatggcacacacctgccaaccagtgggctgggattaggggtataatgtgttgtgatgaatggaccttttctccatgcaatgctaatgggtttatatagaatagaattcatgatacaggtgttattttaaacactgtgctctaaccccttgaaaactgaacaaatagacacatactcattaggccaggaccacatctatcaagttacctaatgcattcccagagcctagaagactactaggcacagagtaaaaattcagtaactatctggtgaatgttaactcacagaagacacaatactgcctctaacttcacctatgaaatgcaaagtagaggcgtaactccaacaaataaagccaagcccagtatttaaaagcccaaaacaaatgaagtgcaacaacagaacaagagctggctagctttccagtgtccccatccaaactagggacacctacagaaacacagaaagttcaaagcctatgggaggggaacgtgggggagggagagggacttatttaccagccccagctttacacttcctccatctcctcctcttctttagcaagatgcctctgtgctttccatgaagaagtcggccccagaacatgacctgcatctcagagaagttctgatttatgaattggcactgaggcgacgtcgctggtgcggaacaccatgacgtctgtgtctagggtatgcgcatatgctgcgtttttccgcaggtgcctcgcagtctgctctggctcttagggcttccgaactcagttcagggcatggattttaattaacgaaatgaaacactggccctacacgacgggacacttaatgaatttatttaatgatgccaaatatggggaacccctttagggagagaagcaaaaggaacaggagaaaaagatcaatttgttaaaagacagtcaaagcaactgagtgttactctcagacaggggggatgtcaactggggagtgatccccagaaaatcaacttcattgtgaaatcagaagtacgagcatctttctttcaactggaattcattgagcatctactgagctgctatttcagcacgcttgctgctgggagacacagaagacatccttcctcctcaacatgcttctgatagacattattaagaaaaactatttttttggctagcaatgcagtttcacctcacatgatttcacttccttggagccgtgaatcagcagtggcagggattatctcccctgaggaaaaccaagatgtgggctggctggctggggtagggtggtgagaggcagtgctgtgcaggaaaggactttctccaggccagcaggctatgcagttacacagaggagcaagccctgcacccaccatcgtgattcccaacccttccccagacctcagcacctccaccaccaccagggaaacaagacacagtcacggcagcggacagcactttaggacaaagggggaaggacaaaggcaggatgtgaggatggtcagggagtgatcagaactgctgggagaaagatcagccattgctaagtgtgtcttcaagccctacacttccctggagagatcacagctttctctggcagatgctcagacaagaggtcacggataggcactgttctggcaattgccagacaaaccaacctctttctgatcccactgagaggctggacaataacacagtctgtagacaaggaaattcaaagcatggcattcctccagggaaaacgctgtgctggaccaggaccagggcctgccaacacctgtgagcagacagattccaaaatgtacagtcacaggctggctcctctgaggcttggctcacagtgcttcatcaaaagaaataaagataaggaagtatcttcctgctatcagcccctgcttcggtggcaccccactcatctcttacccacccttggggagggaatggagatctttaaccctgggtaaagagtacaatgaaacttcattttctgagctcccagaggttttggaacgtgatagctcctacagagacatgattcttgctgaataaataattctaagtcagtgacctgactagggactcatgtctgaagcaccgtttgattcttcaattttcaatttttcctccttttatttactagccaatatttccatgtgacaaccacatgcccatcccattaggagggctattacaaaagaaatgaaaagtaaatattggtgaggatgtagagaaactggaatcctcgtgcattgctggtggggatgcaaactcctgcagctgctgtggaaagcagtctggatgctcctgaaaaagttaaactaccaaacgatctagcaattctgcttctcggtatatgcccaaagcaaacgaaagcagcgactcaacagatacttgcccaccaatgttcatcgaacattattcaatttccaaaaagtggaaacatcccaagggtccgtcatcagatgaacagaaaaaatgtggtgtagacagaaaataatattttgccgtaaaaaggaaaggaattctaataatgctacggcacagacaaaccttgaagagattatgttaagtggaagaagccagacacaaaaggacaaatactgtgtgattccacttacgagaggttctgagagtagtcaaactcacagagacgcaaaacagattggtggtgtccagggttgaggtgaaaggggagtggatgattgtcgcttcacggggtaggaatttctctgaggtaaggaaaaacttagaaatagatatggtgcacaagactgtggatgtaattaatatcactgaattatacactcagagatcattcaaatcacaaactttatgttagatatattttaccaccaaaaaaaacccacaaaaacaaccaaacatgaaaccaaactataaagaagaaaacaaggtggaaataaaaaaaaaataagagcttaagaaataaaaggggaagattgcaaaaagcacacagaataataacattagcaatgctgccatattaactgcatgtagatagtatttactctgtgccaggaattgttctgggtgctatccatataacaacttgtataaccttcatgggaaccccttgatgtaggtttttattattatcctcattttaaagttaataattctgaaaaccagcaaggttaagtatcttgcccaagatcacagagcaagacatggcaaaacctagatttaaacccagaaactcttgacctggaatctatgtttttaaacaactaagctggttgccagtataaaagacctaagagtgagtcaaaaaaagaaaaaaagaaagaaagaaaaaggatttaaggatagggatgtataaacaattatatactacctaaagcaagagagagagaaagagagataaagactaatgaaaccaacatactgcattcttatttcaaaagtcaaatattaattgttccataaatagtacaggatactactgatcttttaggctcacccaagtctctcccagaaaacaaacaataaagcagaaagagcacggaactcgaggttataaaatctgctttaaaatcctggctcaatgacttactttgcttacttcttcatttagcgagtatgtaatgagtacctgctaggcaccagggaacatgctggctagttcactcaacgttttgaatcctagttcctcttttataaaattggaataatatacctacttcacagggttaagaaagctaaatgagataggctatgactgttcttgactcctagtttacactcagtaatggttgactgaagatgttttctcttgcctagtttctcagaataaaaattcgtgatgatgataagatatataaatcatgcggcttgggttttcaatggaggcattgtgactgccaggctgtagacaaatctacacagctactcggctccttgtgccccaccctctttcttacccttaagctggcaagatgatgacacatggcagggcaccgataagtgtcggtttttttctgttcttcccagaaggggtgggaagagacaacagaaaggagaaaggaaaaggagacaggagaaaaaaggaacatggaagaaaaaaaaacagaatgtgaagatggagataggatattacttccttcccttctctcccactggggtagaaagggctgtggtctgcagggggcgtccaccttccatttctctctagaatgtcccatagcatcaaccatgcccctaaaccaaaaatgacacaaaccttctccagactctaaaaagcccctttggaccacacaggacttctctctgtttccccctcccctggacaccaccatacacacagttcaatgatgaccttttattttgcatcatggccaaaacagttattaaggagtttcatttccagggcgctcactaatcaagataacagagactaaaatacaaggcctacaagccttacactcatcactggtgattcgctgagttcaccttgtcaagtaaactgtaagatgctggaagacagagaacgtatctaacagaacatatctatcagtgagtatttgctaaagccacatcttgacttatgacatatggagtgtttggaaacagaagatcacatttctacattccacatagatcgaaagtctagctaacttagagactgctttattttgtccgagtaaggttttccttaatttctaaagttctgtgatggtaagaagaagcccaccaattatcagcccatttacaccacttcactcaagtcttacgaaatgaggccgctgtcctgcgcccccgacgaggagggaaacgagactgatgcaaatgatactctaaggccaacagacagaaccatatttaggatcctatcgggctagctccaaacgctgccttcccacctattcacctgaagttccttgtaatttgttagtgtgaattaaatgacatctcggaaagtgttgcttctgactagtgagaaagttttatgtcaagagaagatgaattgctccaaggagaaaaatatgccaggcaagtccaaacacgtctgcctacctacaagtatgattcccacaagcacgtcctcctcttgccaacccatcttcaaccttatagggtgcagatgtttttgaaagtttctccttgctccaggtactatggaagagacagtgtctggcttcatcctggaaaccatggggtatgtggcatccatcatgttttggagatgggccgtttttacattagccacccttgccaaaatctaagaagcatggctgtttctcatcatgtggtcgctggctctgcgagctgtggtttgaagacggaaacaataataatcctatacataaatgactaacattttatggggaagacagaaaatagtttaaatgttttccatgatcctctttttgaactacaaatgatagtcaaacaggggtcattgccctggctgataattttcagaattgcagaccctacagtaaataacattcacagatggttcctttctttgaatatcaatgctctgccttttgggagctggcagctactcagagaagagcattaaactggccagaaagagacctgggatcctctggatctctttcctttgttcagaacaagagattttgacagattctccggccgccagtcttccagctctggtttccagctctggttctgggcgatccccaagagatcacagatactttgtatactttccacatccaccactgtaattgcagagtccctatcttccttacgattctgtttactagaaccaaacccatcatttttgagacattgccaaattcactgcaggaacaagtcataagtccactgagaagcgcatgccagttgtgaggagactccggtctgacgggcaagatgaccacctcctttttattttattatttttttaaatggagtctcgctccgtcacccaggctggagtgctgtggcgcgatctcggctcactgcaagctccgcctcccgggttcacgccattctcctgcctcagcctcccgagtagctgggactgcaggctcccgccaccacgcccggctaattttttgtatttttagtagagacggggtttcaccgtgttagccaggatggtctcgatctcctgacctcgtgatccacccgcctcggcctcccaaagtgctgggattacaggcgcccgccaccacgcccggctaattttttgtatttttagtagagacggggtttcaccatgttagccaggatggtctcgatctcctgacctcgtgatccgaccgcctcggcctcccaaagtgctgggattacaggcgcccgccaccacgcccggctaattttttgtatttttagtagagacggggtttcaccatgttagccaggatggtctcgatctcctgacctcgtgatccgaccgcctcagcctcccaaagtgctgggatgacaggcgcccgccaccacgcccggcccattattatttctttagagacggggtcctgctctgtcacccagcctagagtgcagtggtgcaatcatcgctcaccgcagcctcgacctcctgggctccagtgatccttccacctccctctcccaaagtgctgggatcacaggcctgagcctccgcgcccggccacctcctcttacagtagttcccaacccattcttcggcctcactgcatggctcacacggaaacatctcagtttaccaccgcacgatgtaagtgcgttctacactcaccaaagagaaaagaagtctgaaggataaggcagagaagagaaaggttgtaggtaggaggattggtgagcagggaagagatatgatggaagaggcggagggaaagacggtaaaggggcgaagaaatgccaagtgaagatgtgtaggcacacagaagaaccgaacccagaaccagaaaggggaaaaactctattgttctgtggggctccaattcacaggtcattaggctttggaggatccccacagaaggttgtcatctgcttctcaaacctctggcaggggcatcaggtgtagctatgctaccacagcgccatctggtggagcggtgggacttatcatgacctaatcaaactcttttaggactaattccgtcttgcaacaattccaggcaataaatacaggtgacaggatatattattgaggaatatggacagctgaagttcacacattgttacgtcctatggattatctcctctcagaacaattgtagagtaactttacaatccacatactgaaagattccctccccattcctttttatctcttcccaccccattttgaacggctcagctatcaacaaaattttcaataagaaatacattgcctttagatgtacctttttcagcaatgtaaaactaccttgcttattattccaatgatctgaattttgagcatctctttaaattacatacagatcaatgtcatgaagcattaaatttattataatatgtaatataaatatctcacacatctagtcattaaacactaatatttactttgttgcctttctttctccacagttttcccatgtgattctcttaagaacaaaatataatacagtcgtgtaaatctaagtgatttattacacaagtgattatcctagagatactgggacccacgacttggggctccaccaatgttcctctgttatataagctcaggtatgagttctgggaagccacagggcatgggagcaaaaccacatgctttggctcagacctcgattggaattcgggcaccgccacttactaaggggccttctcaagcctgtctcctatctgtaaaatgggaatgagcctaccgacttcataggattgctgtgaggattaaatggaaatcggtacgcaaaatggccagcacagtgctaacatctagaaggtgctgcccagccccaaagagatctaccagagaaataataattctcatttttagtcaagctacaaaataagactcctcatttctgatttgttttataaaaatgcaaaaaagagagagaagaaaagccttccaagattctgataccgctcaccccagttttcacttgaaagtcaaccaatgaatgagcaccagggtgaagatggaattctgccagccacagtacctgcaagagtccacaacacacttgactttcattcatgtgtactacaatcctgtgggttaaagggccataaaagttgtcctggtttttcttatacttcaaaggaagcaatttaatggccatgaatgacagcctcccgattacactgtaactatgaaacacgactgttctggaatgatttccaggctggctccctcaccaaaggaacttcaaggtaagaatttaaacaaaataacctttccaggctttcatccagcttcctcatgcaagaggctctatccttgggagcccagggaatgtatgtgcacacaaagggttacgtagggttgaggccagacagagggtggtctggagagttgtgttgaggcagggcaacccagaaaatggacagcactgttccctggggaggcctatatgctacagacactataagaaataaaagaataagggataataattttttttttgagacagcgtctcactctgtcacccaggttggagagcagtggtgcaatcatgactcgctgcagcctcaacctccttggactcagctgatcctcccacctcggcctcccgagtagctgggactacaggcgtgcaccaccatgcctggctaatttttttgtatttttttctagagatggagtttctccatgttgcccatgctggtctcaaactcctgcgctcaggccatctgcccatcttggcctcccaaagtgctggtattatatgcatgagccactgggactggcctaattttaacattttaagggggaaacattacatgaagaatgttggttacaaagaaaaacctcaaaaatgtgggctctgcctatcttactgccattgcttaattagccagatagagcaagccaaaaatattcccattgccctatgactcagcagacaagtataaatgtttctcacagtagcaaagcaaacgcttacagctggaagaccatcacatatggtggagccaacgctgtacttggaactggatttgattttcaatcctggtttctcaattaactagctctctgaccttgggcaacttccctgaacattggtttgctcatctaaaatgcggatagtcacctgtctctataaagggctacccattaaattagaggatgtgaggataagcaaatcaaaactcccttggtatgtcctatgcctcctctcagctggaatacagcagggcctaggaaacaggtccagttttctgcagagagtcatatgggcatagtttaagcatgtaaaggggcacgcttacagtgatgttataaaagcaaaacacaagtacctgcttactgcagaatcctctcacaaacagagaatcctatgaaaactgcaaaagggataaagaaagaaaaagtgggggaagccaggtccttcaaacctccagtcagcagtcactctcaatcattaccagacgtcgtcactgaatttagggcccctgtcagaaccagcacacatatggagccgtggttacaggccagaacacacacctcttgacatttaaagatgttcatcttcaattggcctccatatgagatgtggagtttgagaacctaattgttcccaagctctgtgaatgggttttatatactccgaagacagctagatattgaaaggggagaaaaggcgggatcttgacatttgggaagcaattctactacactgttttaggattggttttaaaaattaaagacggtgatttgatgtttgtgttgaaagcacaaccacgtcctgactgctaaaagaaatctaacctatatgtcatggtcccccaaagccccaaagtggattttaaagttgttaaagtaaaaatctactttgtaggaagagcccgccttgctattctaccttaaaactgatgagcgagttggagggactgggatgttggaggggctggggtgctggaggggcggcggggggcgggacaggggagacacgggtggtgaggaacagtccagggatatccaggctggacccacgtaggttcctcttcctaccaaaggggaactgggacgtgctccctgtttcccagacggaactcctgggtgataatgtgagaagcccttactgcacatctgtctttccccacatacttacaaagttagggggaaagctggaaagtgatatgcagcccctgtataattctgacttattctcagaagattttttaaaaaactaaaaaataaatggaaatcagctgcagccttcctgatgtgtgaatagagacaatttaaaagacatcaagtgccaaatactgacctgtctcgcctaacaaaactgccctgtctttcagcccactgagaacagagggacacacaccacagggaggtgagctgtctcggaaggagccctccacgcagaccccacagctatattaactgtgcttaacgtaatcatgaacacataatcgcggggctattgaagactccataacaaacaagatcaaggagcctggagcctctaaaacatgaaaaccaattagcactatgaaatctaagagcagacacagccagagctcgagaaaaggcatgggcaggagctggactgctcaatcctgctcactcctcccttccttcctgttacacggttctgttctgaggtgctgctgagaggggcttcctctcctgggccagaactgaggctaaggcccgaagctgaggacagaaagtgatcaactccccacattctaaagaggctgctggagaagcggccacgactggggcctgacatccttctctagggattatcaggcagcactctgctacccatcccacaggaccgtaacttatccttcccaatccgtagaaagcaagactctgaagcatgtgcgtttgtctttggccttgtgggaggtttctattcaagaggaaaactgatgccatgaaggatgggatgaggtgctttctcttcccagaagggaaagatttgggtgcctcgtgaaagggagtctggagtcagctccctggtcaatgatctacttgcagagacaactctctgatctcaccttaataaatgagattcattcacctggcactttgggtttcatgtagggggagagatggaagagttaggggaataaaaggagatgaaaggactaaagaaaaggcagaaggaggccgggcatggtggctcacatctgtaatcccagtatttcgggaggtctatgtgggtggatcacttgggtccaggagtttgagaccagcctgggcaacacggcgaaaccccattctaccaaaaatagaaaaaaaaaaaaatttgccaggcatggtgccatatgcctgtagtcccaactactcaggaggctgaggtgggaggatcacatgagcctgggaggttgaggctgcagtaagccgtgatcacaccactgcactccagcctgggaaacagagccagaccctgaccaaaaaaaaaaaggcagtagggcatgacaaaaaatatactgtggggcaatttgtactcagacgtgggaaacaggattaaatgcattagaaaagaactaaactgaaatatttaaaaatgacagtaatcagttaacaatccattccccatggataagaaggctgtgatttttacaccaaaggaaaagtgtttaagtcatagtccctaccataggggcttcaacaaagtgatgccaaagaaagactactgtcctacgaagacagccatctggaggaggtcctaatggtatcacaagcgatgtgacaaaaatgaagtcccttcatttctctcagcctttccttacctgtaaacagggcaagaatggaaggctgaaatagccagaggttccaaacctcaatggtaatgaagaaacacaacctgtgcattgtattctgaaaggcctcggagaaactgtgtccttatccacagacgcacagagcggtgttggagaaacatcagttaccacttgcctaggatgtctaagggctcttgacacatcctgtaatgcgacgtaaataagaaataaaggtgggcctcactgaaagcagaactcctctcagccgaggactggcttagcctgagtttctgggaggtgatctgccctctgggcttcccctccctcggcccattaacatttctgtacttagaagtcggctgggatcctggagggcataagagctgtaagaatgccatgactatttttaaaattttgaaaaataaatactagaggctctggcagcaacagcgcttggggagtagccgtacctctgaagttttcctttcctttctcgagcaacgcagggagggagctgtttaatgaggagtctcaacaccggggaacaaagcagtagtgtttgcacacaaagcttggtgctggcaattttctcggtttcgttttttcatgctgccaaagtcatttgttttgaaaataagagcctctcctttgccctcagcatccctattaagacactaaaccacaggattaattctgtttaggcctgcagagtgaggtaaatcctctgagacacctcagcaccttccccaggtgagacaggagagtccggggatgaagaattcggctctggagtcacagactcaagttcaagtgccagccgtaccgcttgctagcagcgtggccttgggcaagtcacttggcttcggtttcctcctcttagctgcaaaatatgaaaaacgggcctgctatgaaacgactggcccatagtcaacactcagtaaatgataactatataaaataatggtggtaaaaccagcaaaaatcgacaggtgtgtatcgttgggccataatgtgaaaccacgctcaaagtactttaatatagcatccttcaaggcgctcacaatgctgcagactgtaggagcgaagtcagcaatacaggttggaattcatgtattgggggctatactaacatatacaaagtatacgtgatttgtctaggttgtttttgatgcaaaatagcctgaagctagaggacaccacctactcttatctacagtgtcccttctgtttctaggaagagtctacaatcctaactttaatgcatttttgtctaaactaagagtcttcacattttttgaagtcacagaaatatttgtgaatatatatttttaactgggacttgattactttgtaacatgtatgtgtgtatacacatacacacacgtacataaaagggtaacaacgcaaaaggcaatactggtttgtgtatatatcatatagtggaaagaatattagattcaagttagatcatctacttccaacactgcagatggccagagccgtaaggcaagtctctccaatcaggtcttagtattctccttatttaaaaaaggagaaagacattaaaataccttcaaaattattgttgtgaccccaggcagagtaactagaatgaagtagaagaagctattggaatatgacgttgtctcatgtaagatcttttttttttttttttttttttgagatggagtcttgctctgttgcccaggctgaagtgcagtggcgtgatctcggctcactgcaacctccgcttcgtgtcgtgagatcaagcaattctcctgcctcagccttctgagtagctaggatcacaggtgagtgctaccatgcccagctaatagggaggctgaggcaggagaatcgcttgaacccagggggcagaggtcacagtgagctgggaatgcgccactgcactccagcctgtgcaacagagcaagactccatctcaaaaaacaaacaaacaaaacaaaaacaaaaaaacaacaaaaaccccaatattttaaaacataacagtagaaattgtgtttgtgaatgtcataagaagtttctttacttcttctagttctctgttgagaaacaatacagaatcgtatgctctgtctattggggcaacaattcaatcacagcaggataaaaattgacttttaaaaagtgaccccctgctcttgttttctcctctccttcatcagttcactaccagacctcacaccagagatgaagcttctccatgcagagaaagacctaaaactctagcgtgatgtactcatggataagaattgatcaacatgtatccagagcccaatgatgccaggaagaaagcctaaacataatttaataaactccctctctgttttcttcatttcctactactttggtttacttaaaaatgagtgtttgcaggagaaatctgagtgcatttttggcaagcagctgagttatctttgcttattcattaaacgaacagtgtgacggagaaagtccaaataggaaagacaaggaaaaatggggaaaagttgacttctcatcccaaaatatttcttggattaaaaggcaaactcatccaatcttaaggtttagagggctaaaataattgttccatatgtagctgttagaaggcattagatattaactatggcatggtgtctatggatatctgcgtcatctatttagatagtatgtgctgaatatcaaaaacattaagctaaagaaggttaaggaaagatggtgtttccccaaggaaaggtgtgcttatcctagtttgacagtctcctaggaaaacttggatactttcttacataggaaggacatataacatgcttccagagtcacagggtttgaagacggctgaagacgtcatcttgtccccatatgcggcccaggaagagcgaagtctagcaccacattgggactagaaatctacattttaaatcgtattacaaatttagagatctaatggtgtattagcaagataagtttcaaatacatcaacaaaatgataggcagaaggaacctcaaaacttttgtgatctgaattccccatttcatagatggggaaatcaaggccctaagagctgaagaaattgccaaaggttgaaaaacactcctcaaacaccaccttcctcctctctgggacttcatattatttcattttcttttactattctgcctgagctttgactttctggaattttaaataccaatataggaatcatcagctggtgtcaatcctcaataagatgacttaaagtttactcataatggtttagcatggtcagaaagtgaacattattcataacggtttttcatggtcagaaagtgaacactacaggtttggcctatgtgcctgtaaaatttagaaaaaggacataaaaaggaggagaatttaaaaatcacctagaccactgtcgatgctgtgagtgggaattcctacttacaaaggccccagtgcaagctccctcttagttagctgccttctgacccagctatctcaacagagttcattaactctgttaaaaccactaacttatgccatggtaattcacataggagaatggcataactaattaatatgggtggaggggcactggctctagcattaaagtggattgataactcactgaaatctgcatgatcacacacaaactccttatcttgctaagtttacgcttgctccactacacaaactgaacaccagctcttagtaccctcaatagctaccctttcctcactgcagaagaactaagtttttcatcagacacccaaatgaaactgatactggccgtcagtatcattatccactgataccagctaccaattgcttgctggtactggctgtcaatatcattgtccactgataccagctaccaattgcttgctggtactggctgtcaatatcattatccactgatactggctaccaactgcttgctcgatgactgaacataagccaacgacactagccccaagtactttcctaccttttcatccaccattagcataaggaagagaaattcctttgttgtcttcttgagggaaaaactacacaaaatagaaagccttaggctccattacataaagcgttgaaaaccacacaccatgacaataaagacccaagcatgttttcaataaattattttcctcttatttcacactgtgaaaacccacatttgatagactattttatagcaaatgtaccggttatcaataaataagtagagtttccacgtgaggagagaggagaaatctactcccagcatttgcccccttcatgggtgcaacagaacttgtagcaattctctggtttaaacaacaggtggcagtgtcatttctacattttccctggcaagaaacctttgcagtttgtgatttcaccttccaggaggcattaacagttttgtaaccgcctctatcgacagcgtgtgcatatgttcctatgtagtaaatgcaaatgcatgcaggaaaacattgagatttgtgtaaatgcagtttcaccaagtgctactctccccatacccacgcccctccccacacaatagtctatgcacaggcatcatttcccttgaggaaacagcaaagcagggaaaaggcagaaggaaaatcgactccatcacatatgttctgatcctcaattatcatatacatgtctgtcacccacccattcctgccacacatacaagagaaaggatacactacaaggtcctggggcacactttgggcaaatgactgagaaagcgaagttctgagaaatcttaattcacatcaagaaaagcactctactgtactgacatttctggtaggcgctgttttcactcttctgctacaaaagagcatgctccatatttgaaaggaatcaacagaaacaggtcttacattcccacaaggaaaacacagaagtcaggaccattctcacatgtgccgagaagacaagaccacgtttcctagggtttttgtgtgagctttaaataggagaaaagtgccatgtcaagaattcctcattcaatatctatagctcagttttttgttcacatgcattattttattttattattatttttgagatggagtctcactctttcacaccagctagagtaaagtactgcgatcttggctcactgcaacctccacctcctgggttcaagagattctagtgccccagcctcccgagtagctgggattacaggcacgtgccaccatgtccagctaatttttgtatttttagtagggatggggcttcaccatgttgtccaggctggtctcgaactcccaacctcaagtgatccacctgccttggcctcccaaagtgctggggctacaggcatgagccactgcacctggccacataattttataatgtagcagcaggtactctgtggtttctagcctataatgtaacagttattggtttgatatgttacatttatttaattttgaatctgtggtgtttttttaaagcaatttaacaatgaaaatctcgtcaatgcagcagggatgagatcaaactgactgatgggtaaatcaccagcctaaagggacacgccaggtattagacagtctggcatgtgtagctggagaagtactcaaaaatgtataaaagtcaatgagcacatatacggagaattacacagaaaataataagcagcactagaaagagatgatgtgtgttttttgtactgtccctgtcacatagcatcaaacatccacattcctgctttctgagatgagagggttggacaagtaccctcaagaagctttctggtatacggtacacagtatcttattgttttataaatagaaaaaagagaatacagaggaaaaaattaaaatacatcacctagagttcagaggcattggaggaatttggctttcatcagcaattttgcattaaaagcaagtatctgtcggccaggcgtggtggctcacgcctgtaatcccaacactttgagaggccatggtgggcggatcatgaggtcgggtgttcgagaccagcctggccaacatggcgaaaccccgtctctactaaaaatacaaaagttagccgggcatggtggtgcagcctgtaatcccaactactcagaaggctaaggcaggagaattgcttgagcccaggaggtggagattgcagtgagccgagattgcggcattgcactccaggctgggtgaagaacaagactgtctcaaacaaacaaacaaataaaaaagtgagtatctgtcctaagcaacacattgtcaagtgcggcctatatgatttcctggtggtcagataatgttgcattcatgctttctgtaggaagtggggtttcatgaaacagcatgaactatgaactttgaacgaagagtcacgggcttatccctgactctaggacttagtagcgtggttaatcacagccgcattattaatgtctccagttctccaaaatacggtaaatgacaccataacagatcttttgtaaagctatggtggatatttttaaaggattatttattcatagtaggtgtctgataagagctacttttagacttttggacttgtagataacttcttttaatttcctattaaaatacccaggaaggtacagaatccagtgttggggctcataaaccaataccctaaaatacagcgctttgacatcctgaactgaagaagcctccaggtctctctggccttccactttacccactgtctctcaatcttctctctctcccaagcagacgatgaacttgttcattggagttcccttatctgcccaaactcccagacctgccaaagaagaaaacaatcacctctggctctttccctgcgtcttcagtaactgaactcctatcccaggaacaaagactgaaatctgtcaacacacctgaacagactcctatctgctttgcgggcccaacagatggtcccaggccatggtatgttcttcaagcccactgaattccctaaaaatcagttcctaccccgttaaaatcatccacacttccccatctccctttcccctaagaagaagggtgtatacatctgtcccccagggcgtggtaggtcatcactgtgactctccctcatgcacattaacaaacgtgtatgcttttttatgcctttagcagctgattttcagcaaaacttcagaggaaaaaggggacattttcccttggccactccactagccacagtcctataagctaaagataacagaagttcccctatccaacaatctcaggaaagtttcctttaagttcagcattaatcactgaatgttctaccatctaacaactgtatggcattttaaaaaatgtttaactgaggttaaatatatataatgtaaaatttaacattttaagtattcacttcaggggctacaaagtacatttatattgttgcacaaccatcacgaccatccatctccagaactttcttcatcttctaaacctgaaactctgtgcccattaacaataacgctccattcccgaccctctcccctcagatcctggtacccgccattccgtctctatgaatttcaaacatgaggtgcctcacagaggtgaaatcatgcaatatttgcccttttgtaactaccttatttcacttagcatgtcttcaaggttcacccatgttatagcatgtgtcaaagtttcctttctaaggctgaattccattttatatgtggcacacattttgtagatccatacatctgttgatagacacgtgggttgctctcaccaaatgtgtacaaatatctgttcgagtacctgctggattccaattttggggggtgtatacctagaaagagaactgctggatcatataataattttatttctaatgttctaaggaagtagagagcattttgaaatgtgagatcgaggcctaagcagtcattcttgctaactggaatgctggagtgctgagctggtcatggctaggctgatcccgtcagtggcggacagaaaagcattgacatgaggtctataaaaaaataagtatcagccaggcactctggctcacgcctgtagtcccagctacttgggaggcggaggtgggaggattgcttgagcccaggagttcaaggccagcctgggccacacagtgaaaccccatcacttaaaaaaaaaaaaaaaatagaatagtaaaagggaaaggaaacatcatgctaaagaaacagaactggctgggcgcggtggctcatgcctgtaatcccaacattttgggaggccgaggcaggtggatcacctgaggtcaggagttcaggaccagcttggtcaacgtggtgaaacccagtctctactaaaaatacaaaaattagccaggcgtggtggcatgtgcctgtaatcccagctactcgggaggctgaggcaggagaattgcttgaacccaggaggtggaggttgcagtgagccgagatcatgccactgctctccagcctgggtgacaatagcaaaattcagtctcaaaaaagaagaaaaaaaaagaaaaagaaacagaacaacagcattacctgtgaaaaatctttcaacacagcaaacacaagaaatcttgctctcagtaggacaaaggcaggcagaagcactgtggaagaggggccaggaggggctgagatgagggcagaatgagggagcacagcgagctaactaaggtcaaagaaaaagaaaacaaggaagctggaattatgttaccgagaataaaatagacattggaaagaaataatggaaaaacagttcagccaatgtgtggccattcagaagcatcctgccttgtcggtctaatgctaagaatgatgggagaaggggcttccaatctttttctatgattttttttttgtacctagttaaaaacccactgcatttacagttatcaatgaaactgttctgcttaataccataatacaagtgtctttccaaagttttttgttccctgaggacagaataacaaatgtcagaacatgaacatttttagggcttctgatacatactgttgccaaaagtatcagcaaggtatgaggccatcagcactgccaccattaatttttattctttttttttattttgaaagaatcttaaacttagagaacagtgcaagaatagaatagtataacttattttttcttagctatttgaaagttagttgccaacacaatggcccatcacctccaaattgtgtatttcttatgcacaatgacattgtcctacacctatgaaaaccaggaagttaacattgatacattactaccatccaatcctaggttcaccaatcattccaccatgatccttttcacagcaaaaggttccagttcagaatcaaggcttctgtttgcttgactttcatgagcttgacacttttgaagactagaggccagttattttgttgtataatgcgtctcagtttggggttgcttgatgtttcttcacgaatagattgaggttctgcatctttggcaggagcatcacagtcatgatgctgagttctcatatcctatcacgtggtacataacttcaatcagtcttattactgatgttattaattttgatcactaggttaaagtgttatctgtcagacttctccactgtgaagtttctcattttctctttgaattcctaagaatttgggagtggggagagttactctgagagaatgcatatatgacattcctcagcaaacttaggactttaagcactgaactcacaaattcctattttattcagtgagttataacctattactaccgttattttgatgctgaaattgccacagatttggctagcaggagcctcttcaagctgactcctatgtccttctgctatatcctcatctttggacatttccttactttatgaaacaagaagacatcccaggctcatcttctacttctctgtcccagccctggaatcagccattcttccaaagagcacctttaagtagcgaacagtatttagaagccaaagtcccagactaggtgtgcactaggtgttacagttcccaggtcctctcagtggacacagccgggaaatatacgtatgtggaacacacagacacaaagatctgcatctatgtttatttctacacagctctttctctctgtggaataccaagagttcacaccagtctctctaatgaacagagttttattccagttccttccctttccaaaacaaccagccgtgtctctgttgccctctcctgcccggctgccaggtttccacgtgaatgctctcactcccctgagttcagacactcagctttgagccaaagtggcttccctctctcccaggaccccacgctccacagtcaaggcactcaacttgctctgcctcatctcatgacttttgaactgagctttagagaaacagtaagaacaagacattatcaatttcatagatgagtctgaatattttaaatgtttgccatcatatttctgtaaaaattgtgcttcacgtgctttgtctatttacctatacacacctcattgattttaaactttttttctttgtttacagatggggtcttgctctgtcatttaggctggagtacagtggcaaaaatcacagctcactgcagcttcaaattccggggctcatgcaatcttcctgccacagcctcccaagtagctaggaccacaggtgtgcaccaccatgctggcttttttttttttttcctgtagagatggattttgctatttttcccagactggtctcaaactcctgtgctcaagcaatcctcctgccttggcctcccaaagcactgagattacaggcatgagccaccatgcccagcagatttcttcttgattagtttacgctgtatgtgtgttaaaggtatcaatgctttggcttaaatgttgcagataatttcttgatatcttatttggttcttgacttattttttttaatagaaaattgtattttgttgatttagaaagcctgaaccccttgctacttttctatttcctctgagccccatttttctctgagctttttgcatttctgaacttctccattactctccactccagtgattctcaatcagggctgattttgctcctccccctggaagtctggcaatgtttggagacatttctgagtctgaagactgggtaggaaagtatgattagcatctagtggcaaaggcctaggatactgctacacaccctacaatgcacaagacagcccccacgaccaaaggttatccagcccaaaatgtcactagtgtcaaacgctgctctggagtctctcaaacgctttacagctattcttttgatttcttccaaaacaagacattagaaaagaaaggctaaaagaggaatatttttcatgtaggcaatgactttttctaaatcctaggtctgagttacaaatactggtcatagaaccttatagaatccaaaagcattgtcaaaaagaccaaccaaaaaaaccctatctttgttatttccacaaaagatgatcgtagctgtgttcttgacataaagggactcacctaattcataaagttttaaatctgtgtttgtcatgtggtcaagaattcatatctagattacctaggtccatctgtgctatcttaaatgccaatgaaagaaaaatgtaattattaatttaattttttcaaatcctataaggccagtaccaaggtactaaatgtaaatatatacatacatatatataaatgtacatatataaaatacatagttttaaaaataaagaacagtattacaaataaaattgttgctttcttggaactcaggcctttgaaagaaaatacatatatagcagcatggcatgaagcaatttaacaagatatgtaagatatattagaaagaaaggagatttttctcttcacaaacacaatatatatcttcttggttatagacttgttacttgcctgccagaagagtttactatcatcttcacaagtattcaattctcagaaccaagggatttcacagcctcctctacccaatcaaagcagtgtcttatggggtccgtctgaacgtaatcctgtcctactgacggatttgacatctatttctgccaccattgcacaagaacacagcagactgctgactgcaataagacttatctagaggctaacaggcaagcaaaatctatactgatttccttttcttcagcacaataccttttaaaaagtaccataaataaaacagtgttctcaagacctgtgattttcaacgagaaattactaaacacattggggaggcttcttgtggtcttgatttcctaatgagctatgggaaattacataatgaagagaattcttcttggcttcttaggtttcaaaagcctacaaagtctgtaaattctgtttcctttccaacaaacactaaacctaacttggtattcgaaactttaacctctccatttcaaatgctttagttttggtcctgactcattacaagaaaggaggctgttagaatagcaaaataataattatgatgaaatcataacaataataacagtagctaacacttattgaactgagcgctatatgtcagatagtattctaaatgctctatcggtgtaaactcacatcattctatgataagctacaaagtagatactcatcataataatcagtcgcattttatagataagaaaactgaagcccaggagtgtgaataggtttttctaggttagaagcagaattgaagtcagaaagcctgactgtaaactcatggtcttaaccacttttctggctctctgattcccaccctctcaacttttaacgtgactgaatctgaaactcatcattcattatagcatcaaacctacatctccctcttcttaaggcctacctgcatgagcatgtacctgttcatacagctcccagaacaaacgtgtataggtttgtctaagtaaacagcaaatttgattgtaaacataaaaactaaagagaatatcattgctttgtaaaggtaacggtgaatgattctcaacgccaataccagaaacatgtgacaatcacaaggcagtcaccaatttaacagagagaaggaaagtatgaagtgtatctctcagtctctgatagaagttcctttcttcacctcgggtgaaggtcaggagttccacttctactgcccttgctgtcaccaaacagcaaagttcaaggaagacagaggagctttgaagccttctgacatgggtacagaattctactatgtctttttgtttgagtacaaaatatagctctagcctgaagaaagacttagagttaatcttcctgtggtacagatggtatattctgattcctgatcacccacactgcgccacagagcccctgacacagaattgtctgtagttaagtaatgggaggtgaggaagtggcctcagagaaggactaacgtccacagacttgagttcgtacaaccacaaaaatacctgcctggccaactagccacccagtctagcataaagattggtcatgcagatttgtggaaagaaagaggtccaggaaatgcttcttggaaggcagaacatttacttattcatcattatattattgatcagcctccctacaccctgattaattatcactccattgatgaaaagctatctcaattcaattctattgctttctcagcaatacaggcaaaaattttacatagcaagttttttgtttgtatatttttattcatttttcagcaaatcaaaacccattcaaatggaaaatggaaagatggaaaaatgaaactgtgcatttcaatgtgatattgagcataggatatcagcagctcacttcgtgggttctgtgttgcttcgacattctgtctgtgacctcttggaaggtttgactggtaggggcacagcacttcaaactgtgacataatcagcgtttcctctcctaggttaagagggacactgatcgctggaaacatgaacatccacagcaactaagagtgagcactgctgaacacagccacagactgtggtccttcgttaaacaaatgaaagtctaaatcaaatgacgagagaacgcaaattcatgatcattatgaagcaaatgcattgctgtacttaagacatcagtccctctacagagaggccatcacctctttgcacaagtcaatatgggcaaaaattgttttcaaaaaccaggttggttctcaaacattaaaatgcacatatcagagaaaaatgctctctcaagcatctctatacgaagatgttcattacagaaatgtttgttatggtggaaaatgagggccaatgtctatcaataggagattgagtatgagaactacagtgcacagcgagggggtaagaacgtgggttctggagccacgcagccttgctttaaatcctgactttgacacacactaacagtgcgacctgaggcaacttacataacctctgtaaatcttggtttcctcgtctgtatataaagagtttagtaaaacacttgacatatacgagctcaataaatgttagcaattattattatgctacattatgtatatggacattttaaaaagatagggctgtatctatcagcgtagaaagatggcctgtgtcattgttaagaaaatgtttccagcaaattgtagatgggtataactaatataactctgcatgtgcaaatattgtgtggatacacatggaaagtattctgggacacataccaaattgttacaataaatccctttcaaaaattaggagtggctgggaggagaaggctttcacttcgcactttccatggtgccagggtaataccacctcacaacagtaaatagcaaaaatagcaaccttaactctagattttcttatctaaattttaattctgtgaagaattttccatttccctttttcaaatcaggatataggatgcaatttagaaagagtgagatcacttgttagactgtacgatttttaagcatcaataaagtataccaccgaacttctctaccaatccattctctaaacttcccaatcaggtgtgcctctccatttaggacacaggcaggtttttgttccaactcacagtgtaactgccctggtttcagtatccacggtgaatgagaacagctaagagacacaagtgctgggaattaaagaagcatctacttaaaaaccaagctcttgctaatcagtgagaagagtctcaagagatgatatgctgaaggcaccgagggagagctgtgttggaatgtctgtctgtgcataactgtggtccttcaaaacgagcaattagaaaacagagatgagataatatagctagctctcgcagattaatcaaatgtgtcttgttactagattagagaattcaaagatatgacagagaatattaaatgtctgaaaatgaccaagtgtagctgcttgaatcatttcccccacagttttcagtagaaaagagttgttctttcccattttccaaaatcattactattttagcattgtcaaggaaaaaaaaaggacttatgttttgtacttttcacagtgtagaggatgatgctcagaataaattgtttcactttgggagttatatttactagaagaatgaagctcttgctttccactttaagacaaagagagggacatacaacaaaaaagacggcacgttcaggggctacaggggcgtgagttcaaatcctggatttccaatttccagctatgtatctttggtgagtcatttaacctcagaacccacttcacaggactattacaaaactgtgtgtgtgtgtgtgtgtgtgtgtgtgtgtgtgtgttactgaaaaatatcacccagtacttagtacacacctagtagttgttagctactatttcagagagacttctgtggatggcatatactgatgatttggttaaaaaaataaagaataaagacagttaattctttcaaaattattatatgactatcactgttaggtgggaggggataaaatgaggaactacagagatcactgaatttacagcaaatgtcctggccaggtaacctagaggtcaaattgagatgaaaatcaggttgcttctatcatagtccaatattttttcatactccatcagattctgctttctgcaatataatatggaagcgagaaaacaagaaatattccaggatacagtcacagatgtactatatagcttacattttatctttttcccaaaaaagaggaacctcattctgcctgaacaacaaaaggttaaagatgtattggtggacagcatctaggaagagagatacaggaagtggacagcatctaggaaggagatacaggaagtggacagcatctaggaagggagatacaggaagtggacagcatctaggaaggagatacaggaagtggacagcatctaggaagagagatacagcaagtggacagcatctaggaagggagatacagcaagtggacagcatctaggaagacagatacagcaagtggacagcatctaggaagggagatccaggaagtggacagcatctaggaaggagatacaggaagtgggcagcatctaggaagagagatacagcaagtggacagcatctaggaagggagatacagcaagtggacagcatctaggaaggcagatacagcaagtggacagcatctaggaagggagatacagcaagtggacagcatctaggaagggagatacaggaagtggacagcatctaggaaggagatacaggaagtggacagcatctaggaagacagatacagcaagtggacagcatctaggaagggagatacagcaagtggacagcatctaggaagggagatacagcaagtggacagcatctaggaagggagatacaggaagtggacagcatctaggaaggagatacaggaagtggacagcatctaggaagagagatacagcaagtggacagcatctaggaagggagatacagcaagtggacagcatctaggaagacagatacagcaagtggacagcatctaggaagagagatacagcaagtggacagcatctaggaagggagatacaggaagtggacagcatctaggaaggagatacaggaagtggacagcatctaggaagggagatacagcaagtggacagcatctaggaaggagatacaggaagtagacagcatctaggaagacagatacagcaagtgaacagcatctaggaagggagatacagcaagtggacagcatctaggaagggagatacagcaagtggacagcatctaggaagggagatacagcaagtggacagcatctaggaaggaagatacagcaaatctaattcagaagaaaagaaacagattgccctgaatatgacagtggccatcagaaagggagctgtaccctccacccaaatgtgtcccaaacacaaagacgtctcacatccctctaaaaaccgaaaagaggtaccagtactgtgacggtcattttctggaattcattaattgaatcatgaagagaattatgtaaggtcaaaacactcatacctcagaaaaagctgcgtcctatacactaggctagcccacaccaaccacaaagaaagcacagacagaaatttccaggacttggtgtctttgcaaagacagagactccagccataagcttagcaatgtaccctcttgatgaaggaagtgagcatgatctctccctttgtcatctgagtgatgtatgattaagctcaatagaggtatagattcagtgatgttactgagaggaagcaacagaattttcagtgacctaaggtgctatatgtgagagtcccaagtgttctaaagaaaaacctggcccagcacagtggctcatgcctgtaatcccagcaatttgggaggccgaggcaggtggattacctgaggccaggagtttaagaccagcctggccaatatggtaaaacactgtctctactaaaaatacaaaaattagacacacgtgctggtgggaagtcccagctacttgggaggctgaggcaagagaatcgcttgaacccaggaggtaggttgcagtgaaggcagagattgcagtgagccaagatcgtgccactgcactccagcccatgtgacagagtgagtgagacttcatcccccacccgccaaaaaaaagaaaagaaaatgaaaacccataccagaaaaaaagtttctctttcttcaaaaacagtccttcttttgaccttccctaggtcttgcagaagagagcataaagaagtcttagatcaaatactcatttatatcagtgacttctaagtaattacctgcatctataggatatacagagtttaatcacatacccttgaaagacgcactccactaaacaaaattataagtacacctcattgcgtgtactgagcttcactctgctgtgcttcatggatcttgtgtttactagatagaaggtttgtgaatcctttgttgaacaagtctattagcaccatttgtccaatagcatgtgtgcacttcatgtgtctgttgtcacattttggtaattctcacaataattcaaactttttcactgttctatctgtgatgcttatcagtgttctttgacattactactgtaattgttttggggcaccatgaacagtgcccatatgagacagttaacttaatccatgaatgtgtgcattctgacagcttcaccaacttcattcctgtctctctccctctcctcaggcctccatatccctgagacacaataatactgaaattagcccagttagtaaccttacaatggcctctaagtgttcacgtgaaaggaggagttgcacatctctcgctgtgattcaagagctagaaatgatgaagctcagtgaggaagacatgtcgagaactaagataaactgaaagacacatgtgttgcacaaaacagttagccaacttgtaaatgcaaaagaaacactcttgagggaaattaaaagtgctactccagtgaacacacaaataatcagaaagtgagacagccttattgctgatagggagaaagtctgagtgatctggacagaagatcaaataagccacaatattcccttaagccaaagcctaatccagaggaaagccctaacttgcttaaattctataaaggctgagagaggtgagaaacgacagaagaaacggtggaaagtagcagaggttggttcatgaggtttaaggaaagaagccatctccgtaacttaaaactgcaaggtgacgttgcagcaagttatcaagaagatctagctgagatgactgatgagggtggcaacaaggaaaagcagactttcagtgtagatgaaaccgccttatattgggatgagataccatctaagacttccataactagaggagaggtcaatgctttgcttcaaaacttcaaaagacagaatgactctcttgttagggtctaatgccagctggtgactttaagttgaagcaaatgttcatttaccatttaaaaaatcctacagcccttaagaactgtggtaaatctgtactgcccatgttctaccaatgtaataacaaagcctgggtgacagcatatctgtttttaagcatagtttactgaatatctgaagtccattcttgtgacctactgctcaggaataagattgctttgaaaacattactgttgattgacaacgcacctagtcatccaagagctccgatggagatgtacaagaagacgaatgctgttttcttgcctactaacacaaaatctagtcttcagcccatggatcaaggagtaattcaactttcaagtcttattatttaagaaatacattttgtaaggctatagctgccatcaatattgattcttctgatggatctggggacagtaaattgaaaaccttctggaaaggattcactattccagacaccattaggaacactcatacttcatagaaggagatcaaaatatcaacattaacaagagtttggaaggttgattccaatcctcatggatgactttgagggggtcaaatcttcagtgaagaaagtaatcagaaatgaaaaacaaggcattacaactgataccacagaaatacaaaggatcattagagactgttacgaacaacaatcttgacaatgctgacaaactgaaaaacctaaaggaaataaatcctagacatacacaacctaccaaaattgaattaggaagaaggagaaaacctgaaaaaatcaataatgagtagtggaagtcctagtcagagcaaccaggcaagagaaagaaacaaagggcatccaaattggaaaaaaggaagtcaaattgtccctctttgtgaatgacataatcctatatacagaaaaatctaaagactccaccaaaaaactctttgaactgataaatgaattcagtaaagttgcaagatacaaaatcaatatacaaaactatacatcaataacgaagtagtgaaaaaagaaattagaaaagcaattccacttacaacagctacaaaaacataaataaagtatctaacaataaatttattgaaggaggagagagaactctagaaggacaactatgaaacactgatggtagaaactgaagagaatacaaacaaatggagatgtcccatgcttataaattggaagaattaatattgttaagatgaccatgctacccaaagcaatctacagatgtaatgtaatacctgtcaaaataccaaaccacatgtttcacagaaatatttttttaaatcctaaaatttgtatggaaacacaaaagaccatgaatagccaaagcaataatgagcaaaaataacaaaacaggaagtatcacactacctgacttcaaaatatgctacaaagctataggaaccaaaaccatatggtactggtataaaaacaaacacacaaaccattagcatagaatagagaacctagagataaattcacatatttacagccaaccaattgtaaaatgtgtcaagaaaacagactgaggaaaagacaccctgttcaataaatggtgttgggaagattccatatccaaagcagaagagtgaaaggagaccattatcactgtatacaaaagtaaactcaaaatgaattaaagatttgaacataggacccaaaactataaaactactagaagaaaacacttcaggacattggtctaggcaaatattttatggctaagacctcaaaagtacagccaacaaaaatagacaaatggcactatattaaactaaaaggtttctgtacagcaaagaaaacaatcaagagactgaagagacaatctgtagcaataaatatttgcaaattacatgttcagcaaggaattaatatccaaaatataatccagttaaaaagtgggcaaatgatatgaatagaaatgtctcaaaagaaaatatgcaggccaggcacggtggctcatgcctgtaatcccagcaccttgggagacagaggcgggcagatcacctgaggtcaggagttcagaccagcctggccaaaatggtgaaaccccatctctactaaaaatacaaaaaattagccaggcgtggtgacacacgcctgtaatcccagctacccaggaggctgaagcaggagaattgcttgagcccgggagacagaggttgcagtgagccaagatcctaccactgcactccagcctggctgacagagtgagactctgtctcagaaaaaaaaaaaaaaaaagaaagaaaaagaaaaagaaaatatgcaaatggccagcaaatatatgaaaaaatgttcaacatcactaatcaccagggaaatacgaatcaaaaccacaatgaaatatcatcttaccacagttaggatggctgttatcaaaaaaagaaaagataacatgctggtgaaaatgcagagaaaagggaactcacacactgttggtgggaatgcaaataggtacagccactgtagaaaagagcacagcatttccacaaaaaaactaaaagagaactaccataggatccagcaatcccagcactgggtttcctttctttctttcttttttttttttttttttacaaaagaaaggaaatcaaagggatacgcacacccccaatgcgtattgcagcactattcacaatagctaagatactgaatcaacctaaatatccatcagtggatatttaactccataaaagacatacaagtaacaccactctactttcacgcatgaagcattaatggataaagaaaacatagatacagacatgatggagtactattcagccatagaaaagaatggaatcctgtcatttgcagcaacaggaatgagcccgaaggacattatgttaagtgaaatatgtcaagcacagaaaaacagatatcacatattctggctcttatgtgggagcaaaaaagatgttgttttgtgctcatcaaagtagaacttgtgggtattggaggctgggaaatggaagaatgggagggaggttgtttgatggatacaaaattacagttacatagagaggatggagtttgcgtgttctgcagcattgtacgctgaatatgctcaactgtattatatttttcaaaaagttagaggagagtattttttaatgttcacaacacaaataaatatttgaggtgatggtatagtgatcactctgatttgatcattacatattatatacacatatgaaaatatcactctgtatcccataaatgtgtacaattattatgtgtcaactaaaaaggaaaaaaggagttgcaccatcgccacacctgtcacatagatcataaatacaaacccgcacacaaattacgttatttactatgtatcattgatgtcagagccctaaaaagccttattaagcctcttgactacagttttcaaacttttttttgcagtggaacgcttacatcaaacaatgttacgtaaatcccaaaatagaatcccccagtaacagtgatctcatgaaatcaaggcaaggcatgtggacgtgtttagtgggggtgcacaagcatgcctgtgcttgtagggagaggacagggctgcttccccaaaacactgtttgaaaaaatcactgatgtattacaagcttcttattcccagacaaacttagtatggaatcacctgccaggtaaggaacttgcttatacataaagtgagggctatagactagaccttttatctgtatgtttctagcaatgttttatgacactattatacagggttttcataggaaatcacataaagaaaggaccattgatacgataatcattataataaatcatactaaatgatcttggtagcaaactagttgtcaagcaaagaaggattatgggtttattcagaccaacttctggaatcttatttaggtattaaatatatattaaatatcaaggtcagaaaccaaatgaagtattaactggcaaaatccattattacaatagaaataacattgatccctggaaataaaaattatttcagattaaaaagaagttatggggccaggcgcagtggctcacggctataatcccagcactctgggaggccgaggcaggcagatcacgaagtcaggagatcaaaaccatcctggctaacgtggtgaaaccccatctctactaaaaatataaaaaattagccaggcgtggtggcgggcgcctgtagtcccagctactcgggaggctgaggcaggagaatcgcttgaaccagggaggcggaggatgcagtgagcagagatcgcgccactgcactccagcctgggcgacagagcgagactttgtctcgaaaaaaaaaaaaaaagttagtgaagaagctgatttcaaagggttttactgctatgaagataaaattaggttggtttcattctagctttattgtagtctgcagagactaaattgaaatcagccattttaattcagaaacaatatttaggctgtagaaagcagagtgataaccaccctgcctttgtttaaaatctctgagacagaagggatatttcctgtagcagcataaattacagagactctaaagttacgttgaaacgacccttacaccctcgaagcaacgtgcaattttgtggctgtaattttctcaaactgcttaataaaaccttctcctttttatcagaaaaaaagaataaacaaaataccaagaactccataaaaggcatacaaggaacattactccactttcagccatgaagtattaataattaactgttgggcaggcaaactgagttagcagtcttttcccacaggacatcttcctgtcaaaatgtcacccagaaataaccctgtagattacaggaaggggctgcaattccccacagtgcatctcataaccataaatggcctcagagtttcagtacctgtcatgatcaggtcacctaacacctgggaatctctcactctccccctcctctacccacatatttgccgctaacacaccaataattgatagtatctgcatttctgagcattaccagccatgagctgcctgccctagcactgaaggagagacagatggcagccagacagaacgggatggagagctcatatccgagtcctggctctgcccttgattcactgagcaacaacctctcaccaaagatgggatcataaagctccattccctcgcattcaaatgctaggaatcctaatttgataatttctaccatgaactttggtgtcttctgtactcatatttgctttctgctcttttgaggaaaaaaatcagatacaatattgtgactatgaaatcatcttctcatttttagtgattcaaggtcaggtgaaaacagaaccgttagtttccattccaaacactgatacatgtaaaaggttatatactttagcagagtcctcactggaaaagatgtagatttggagagttcaggcagacatgggttcaagtactggctccactacttaactagttatgtaattttgggtatgtgaactaactactctaggctttaatttcctcaaatgtatataataagaatgataatcatgaatgctttagggatcgctgcaagttgcaagctaaacctgctaaatatgcaactagcatacaaccgagcaatttgcattcctgagcatttatcccaaagacatgaaaaaccatgttcccataaaaccagtgcatgaatgtttacagcaactttatttatagtaataaaaaactggaagcaacacagatgtccttcaaagggtgaaaggttaaactgtggtccatccacaccatggaatactaattggtaataaaaaaaaaactagggataagggcaacaacctggataaatctctggagagttattatcctaagtgaaaaaaaaacccagaaggttacacactgcattttctatttatacaactttcttgaaatggcaacattagagaaatggagtacagattagtagctctacaggttaaagagcggttgggatgtaaggaaagtgaatgtatctataaaagggcaacgtgaggaattcttgtggtgatagaaatgccctgtttcttgaccatatcaaatgtcaaaacatcaatgttctggccgggtgctggctcacacctgtaatcccagcactttgggaggccgaggcaggcggatcacgtgaggtcaggagttcaagaccagcctggccaaccatggtgaaaccccatctccattaaaaatacaaaaattagccaggcgtggtggcgcgtgcctgtaatctcacctactcgtgaggctgaggcacgagaatcgcttgaacccaggaggtggaagttgcagtgagccaagatcacgctaccgcactccagcctgggcaacagagtgagactctgcctcaaaaaaattaattaattaattaaaaaataaattaaaaatttttttaaatgtcagtgttctggttgtgatagttttacagttttgcaagatgttgccatctgaggaaactagataaaggttacaaagtcctctctgtgttctatcttacaactgtatatgaatctataattatctcaaaaataaaaggtttacttcaaagaaattaaaataatcatatttcagaatatcactgcaaagattaaatatatagaattgagcaataatttaaaaattattacgtatatgaaaaattgcctagcacagacagttcttggcaataacagaagctcattaaatgttaatttctttcctctaagaagttgtacatagacagaatgcatcctagtagatttttatttgtggatcaaatgaagacgtaactccatgaaagggtctgatcataacatacacactttttggaacatttagcctttttttccctatgaatctgaactttgaggaagtattatttcacgctaaataacattcatccacattcctacagcaaaactgtacaactcaggtgccaactaatttcttccatcaaaaaatatgaccagtggagcaggttgtaggggattatgatccagttggttaagagtcacagtcaaaaaagatgaatcaaggccaaaaattaattggcatgctcttttacagacaatgaagaaagaacatgaaaagaataaagcttggtttcatgtgctcaagagttcacagctagttaagacaggaaaagtctcatatatgaagactcagagaacaagtggagaacagaccatcagtgcaaaaaatctgcagaagaggtggaggtgagcatggctgggggcaaatgagtgcagaagagggaggtgagaggtgagcaaggctggggcaaataagggaattgggggctgctggctccacacagcactgtcggactgcgtgaagaactgatggcagacgcacgaccttggccttctggaggaccgcggcaatccttagtactttgccgacgctgcaatgtaatcccacctttcccagagttctccatcccctgctgccagatccctgccgcacaaattcgcttgtatgaagctcctggctactttataagtatactttataagagaaaatacagacacacagacaccttcctcccccaatatatgcagacagtatgaagcgtcatagtgttccggcctcaaaaataaaattaggaggaaagcctgtggcacagcaaacgtctccccagcctcccacctgaccctacccttccaggtcactgcctcaggagataaaatcacccaggaggccctgtttaaactcaattctaagttaaggcctgaaaggatccatacactgtccaactctttttcatgccaaaattaatatagtaaacatatctttgtttcagcaatcaaaacctggcaatttgccatgtcaacccccattccacagccacgtgtctgaagaacatatgctttcagaatggcgtttatgatctcaatgccatcttgctgcaagccttccagctaggatgttccctgtagttgaaataaacggaaaggaagtttctgagttgaagtaaaccgaaaggaaggagggtcacagccccgcggcacagttcccaggatgactgctgtgccactcacaaaatgagccttttgactgactccagcagcaggacgggactgtcgtttcacgaggtgagctacgggcagacagatgtatccgaatcgcattaattggaacatcttgtcacaggataagagaatttccatttctctgcggatgcctgtatgctacacatggtatctggcaggtgtgagaacctcgtctttgattgcctatattcccaatctcctttctttgcctattttcctgctgcaaagcaattacggctgaaaatcagtctgcaacatgcgctcatccatattcaactctttccacttcaggcaaatcttgcccagaaaaaaaataataaaagagagagacttataaatccagatttgtcttttattttgatcctctgattgtccaggtgtttacttgttgataatccaccattttctccacatcaaaataaatattctaaagatgcagctctaaacaactaaagcatgtacctgtcttaagtgacaaggagggatgacacacctacaaaactttcaataaatcgaaccaacagatgggagcagccagaaccagttgaaagtgcaaatgacggagcatttaaaaaatatacagtgtcattgattttaagtatgttgaagaaaaaaatttaagaaacagtacctgggacttataccaacaggccaaggttaaaattgggttgaagaggagacagggcttcctcctggaagtccttcaagttatcatttcacattggatttgccaatcagcttttcagatcttatctgataattattgaaagccacaggcagggactagaattttgagatgtttctcaaattttcagatgaaagctgtttacctggcccttaaggagattttaaacttattttaatcagtattcaaaagacacaacaggatgaccatccccccatccacccccgcagtctccttctccagaggcatccaatttcatcatttcttgggatgttattttatacatacacaagaacatgctttatatcttccttttcttcattttttacacaaataaccataaactacacatcctattttattttctctgtactcttctttctctcttttttttttttttgttttgttttgtttttttgagacggagtctcgctttgttgcccaggctggagtgcagtggtgcgatctcggctcactgcaagctccacctcccgggtttacgccattctcctgcctcagcctcctgagtagctgggactacaggcgcctgccactaagcccggctaatttttttttttttttttgtacttttagtagagatggggtttcaccatcttagccaggatggtctcaatctcctgacctcgtgatccgcccgcctcggcctcccaaagtgctgggattataggcatgagccaccacgcctcgccttttattttattatcatcatttagttatgaaagccaaagctgagacaaattctctgtactcttaatggcataactgagcgttgatttcatatgaggacacaaagagcttcctcatcgttttttatggcttcagagaattcccttgaatggatgtagcataatttatataaccagttccctacagatagacatttaggttatctccattgtattcctattacaaacaaggttgcaataaataaccttacacataggtcatttcatgtattagctaaagtatcatgtattagctaaattcctataaatgtaattgctgagtcaaaggatatatgaatttataattttgaaagatattaccttcatatatacatatctgtatctatatagtacctgtttccctatacccttgccaatacaaggtgttaacattctgctgtttgccaatctgataggttaaaagtgacatttcagtatcatattcatttgcactgctcttattatgaatgagctgaggagcttttcatctgtgtcataggaagctcacccctgaggacagcatcacctggactccctcctctgataacttctgggaggcactagcaggaggttagcaggtggaaggagagatatctttcccatttccatcctgcttcaaggacatatttctcacagtggctacatcctccatgatcacagccttcttcggatgacccatctttcctgctccggcaatgccgttctctctctttgtccctgccttcaatcccagggatagtaatagcttcccacatttgcaggtctccgagcgtcacaatgtcattccctttttgtccccaaaatcctgccctcacctctgtaagttgccccatttggggagaagaagcatttgtggagaaacctgtttgctattgctttgttttcctgagacactaacaaacatatctcctgcctatttttctactggtttgttggtcttttcatattgatttgtagttgtagcaactccttattcatcagagcaagagttggcaaacttttctgtgaagtgccagataataaatactgttggttttgtggaccataaggtccctgttgcagctattcaattctgccaccatagggtgaaagcagccacaaacaatatgcaaacaaatgagtgtggctgtgttctaataaaacttgattgataaaaacaggcagcaggccagatatgggccttgggctgtagttcccaaccccagcattagggaaattatcttttctctgagatataagctgcaactatttttctcccagtttagttttttacttgtcttatagtggctttgccatgcagagttttaaagatctcttattttacgtagtggaatttatccgtaatttatggcttctagtttttatgtcagagggaaagcaaagagttagtaaaaccacaggaaactcaaagaggaaagactgtaccttaagctagtcagaccatgctaccaccaagagtcttcttaatgagacaactactcatccttctaagacagaattatcaaaaactctttcttaaaaagcaaacgaacaaatgaaaactttcgacggaaggctgagacacaaaatggagcgagcatcctggtgggagccaggacgtacctatccacatgtgcctcgggtaactctcaggccactgtattctagacgttaaaaaacacttctcgacacaaatacgaatcctatcaaaagaaaattagaaaagtgttttctaggtgatcgctgtataaaaatttcacaaatcacccattctatcaggctttgcctagctccaacatctttccgacatcagtgacatgggggcatctgttagagttcttacaactaggggatctctcgggatttccacttcatactcattcttctgttcctgcatgactgtgctccagggtctaaaggctcctagccttagtttgtaatgaatttagtttttgcattctataaatttaaaacaaatatctttgtggaaattttgtaagtagaaacagggaaagtaaaatgttgccaattaaaatacatgttatttgcataaaataggcaagactttcaggaaaaaaacactggggaaaggatgggaaaaagaacaaacaaataaacaaaaattggccgttcaagtctctaccagagtttaatattttaaagtcacaatttcctttccttgttttctcctaccatggagaagcagacacagttataagtgaaggaacaaaacatagaccgtggaaatttggaggtttcagcatggatttgcatcctaaaaaatacaaatagcaatgtgtaataacaatttaaaatctctcttgttgaattacaaaaattatcctggcaattgtagtcggttgctctgtcctgaccaaaacaaagttattcatatttatatgccctcatccccatatacatgcatattgagatgtatattttatttatatgttcatctagatgtaaacataggtatatgcagatatgcacccaccacacttcactatactgtctacaacatgcatattagaaaatgtgtatttaccgaaaccaacatataaaaccaaagtggcaaaggctttggggaataagaaagacacagctctgtaataagtctaacacctgtgaatgatctgtagcagccttcgaaatgtgggattgctgtatccctcaaactgatactacaaactgagatttcatgtctccatttacacaaattgattccataaattctactaagcgccaatgggtaagactcacagcatgtgagatcaaaagagtaggagtaactggcgacagtttagttgagccacaagatgacaaacatcagtcacagggtagtaaggaggggagaatcatccagagaaaagccgtggagaggcgttttctcaattgattaggtcatgctgtaatggagccaagggcgcaggttcagtactctctgccaatgacctatattgtatttcaaagacacagaccaggcccaatagttctcaacatcttgccactagatcaaaagggatatgagaagaagagtggctaagcccaagcttatttcaagtactagaaaagtaacaacattaacgcagcattgattagtaccattgtcttagcgtaagttacagttaacgtccgacatgatctgtgatgtaatagaattaagtaagacatttctcccggctagtattaaactgtatttattcagtcaaccttacaagatcctatcatgaaacagaaatagcattcacttttcaaatagctgtattctaacacgtggtttgcaattaatattgggctgttttggatatttcctgtattacatatacaaccgggatattaataacaacaaagatgaaaacagaagaggatttatgtagctccggaggggttcaataagtaggaacatgacccggattcaagcttcctggcacagacaccccaccatcacagcttattcagaaattaaatacttgtgcttcgccaccacaaacgcaagtgctgccgcttatcttttttctcacgaaaatgtgaccttgggctcagaatggtgctgacccaacgtctcacttctcttagaagaagtatctcaatgaagctgatgctgccgtctgagcactgctttctcgtaggaatttgccaaattaacccaaaatgcagccagccaccaaacagagaaacaatttaagtttagccacgtggggataaatccttctggatgtcaaggtcctcagctggggcttatattaaaccagtagttaccgactccattccccagaacaaaatgactcatggggctcccgtatctcctttcatttgaaaaggtgctgaggtggtaaaatattctgaaaactcctgtagtcattgattcctcagttcttatagagcgctagaattttgtggtctacatgtcactgattgtaacacatcttaatatttgctgcttagaaatatgtttgaaaatcatgtaaaatatcgcacaaatagcaaataactagaagatagatggttgtgtctttttccctctctgatatatataaattctccaagaaccacatggtagaaaaaagacagatatatagtcacgcactgcataatgacatttcagtcaaggacagaacacacatacaatggtggtcccataagattataatactgtatttttactattccttttctatgtttagatacacaaatacttaaccttgtgttaaaattgcctcagcattcagtacagtaacatgctgttcgggtttatagcccaggagcaagagacgatacttcacagcccaggtgtatagtgggctataccatccaggtctgtgtaggtacctctatgatgtttgctcagctatgaagttgcctgaagatgcacttcccagaaaatattcccacccttaagcaacacacgctggacccaccatcctgagggtggaaagaagctctttagagtccccacagagtgaaatgacttcatgtttctcactctctctcctcagtgcggacttcaaaataaaaatactaatcatcaaaagacaaaattctgcatatgctgaaacctacataacagcattctgaagtttctaatagtaagtttcttattagcttgtcccaagttaaacttcttttgtgaaaggaaagtctctgtgtgtgtgtgcctgggcatgtatcccagtgttgccagggccctacgtcgtatgcacacgataagtccaagacctgtagtgggtaaactcagcaatgttcatactctctaagtaggtaacgctaaaggaagagagagaaaaacattcatagcctgagtgatcacataaactgggtatatcagaaaaatcatgacttctggttctggaagagaattggagggggtataacctctcttccaatggacggactcagagttatacctagctcaatctagatggtatgtaatctttattgggaaaaaaaaaaagggtgactaaatacatacgctttaatcataatttgtattcctagatgaaactaccaataaaaattgctacctgcgtatttcctgggcccttatgaggtacactctgaaacactttttctaacactctccaccacaaaattggttttattgctttcatttcatagttgagaaaatgatggattcaaaaagattaagcaatttgttcaaggtcttatgactgataagtcacattttgaggatgggaccccaagtccatttgatttgaatgcccataatcctctaactgcagaaagcttcaagttttctgtgtgttctggaaggcacagctacaaagaaaagctaatatttccctctaaattctacctttatatagctcatcatttgaatttataacactctccagcagtaacaaatacttacgtttctctggattcacagatatatactaaatattttaagaatggagagaaactaagattggaaacaaattaatatgacaggaaaaaaactgtggaggaaaatccatgggaacgtataagaatataactgtaattcaagagccacatactcagggtttgtaaaaattcctaactgcagattaagcagtgaggagctcagcaccttccacaggttcacactccaagccacggagcactcagtggcaccggtctgctctttgggaacaccgttcaattacctctctccatgtaaggacttcgcattattagtgaaccgattctaacacaggaacctcctatgatgtcttaagttcagaatatttctccctgatcaccccagaagaaatcagagctgcgttaatcaatcattctcttacacggtttcctttgtatagaaccactttgcaccctttttggtaagttacctccttcttaatcttcaggactaagctcaacacacacttcaaagcctttctgaacccattctagtatggctgccctgttttgtcttcccccaaccccagaaaccctgtatttaccttcaacaaagctttgaccacacattctctgctatgttttttactggagattaattttttactcattttgttgaggctatttccaggggctctgaatagtggctactcttaataaatacgtaaatatactcttagggataaatgaaaaatcaaatggtccgagtggcctaacacaatttccagaacacactgggaaatgtttgtctcttttttcagccattgtcactacttctttatccccacctctatctacacataaataaacacatgccaacacctgcacttaagtatgcacatgtacacatatacacagcatcgattactccatggattaactctgcttcatctactacctttcatgtaaaaacaagacaaaggaagaaatttaagaatttatgatattcacacaaaatcacataatctaccaaagtctcctcatgcattgcctttattcagactaatatttactgagcacacagtactatgtaaagcagtagaagccaatcaattaaaatgctcatatgttctgaacataaaatgcttcaacacccactacagacattcagaaagatccaaaaaagcaaaattaagtcctgcccatattgaaactatatcttgagatagaaccaacacaaccaaaacaaggtgactattttaagatgaggaatggctgggaacacaggaaataacccaatgggacatgagtgtggctctcagcctttggacagatcatgtgacaacaaataaacacacacgttctcctgcagggcataggtttctggtgaagaatcagtggtgacttggagcaagacaccagatgataatttgataaatgctgtttacctttaaaatgtgattaaacagcatttatgatgaacatgctcagccaatgatgaataatatgtgcagtcaagcacaacagaaagtaattgtctgaggaggtagttcttccctggcagcttcccaaagctctcacagcgtgccttccccttcctcccaaacactggagttggagttagagccctgccagaggagaaaacctggctacagagagtggactggataatgactcgcaccaacagtttcggggatctccaggtacagggaagcctgttcgcacattcacctttaggaatattcaggactcgctctacctgctgcagtgtccgcacgtggttcctggtgtggtttatttttctctcacacctcagtgaggttctttcacagcctctttagtctaagatttcaatttttaaaacggagagagatcattccacaaaatattatatattccagttttcttctaattcaacagttctacgaataaagaccaacttgaactgattcacagtgcatttttataaattaagaggagtttctgtgcaaaaaaaaattcattacctcaatttagttctcagtgcaaattataatgattcctggttcaatttatagaaaatagtttaaacaactccatgtccatacacaccaaaataacatgttctgggtaagatacacaggtgttcatacagtaaacatgagaactccatgtcaaatggagatatcgcatgatgtctattttaccttcagagaaatgtgcacaaactgggtaatgatgatgccagtacaagaacttgcaaataaatgggttgtttgggcaagaaattttgtaggtacgtaaaaccagaactaatttatagatcagtcaggctccgtctcatgcttggcagagaggctagaggtcactggtcactgaggaaaaaaatgcttacaaactgatttccagcccagttagcaattttaccagaactctttattctatcaaggctgcagaagagaggtaatgaggtcccatatgtacaggtgtgcaacaaattaggtcaataaatatgtctgttaaaaatacttaaataggaaaggtaaaaattacttaaacatgataagaaccattcagcaaaattcaatagcagacttaatgctcagtggtgaagtgttaaagccatttttattaaaatgacaaactggactaggataaccattattgactctttataaaatattgctttgagagtataaaatacctaggaatccaacttacaagggatgtgaaggacctcttcaaggagaactacaaaccactgctcaacgaaataaaagaggacacaaacaaatggaagagcattccatgctcatggataggaagactcaatattgtgaaaacggacatactgcccaaggtaatttatacattcaatgccatccccatcaagctaccaatgactttcttcacagaattggaaaaaactactttgaagttcatatggaaccaaaaaagagcccgcatcaccaagtcaatcctaagccaaaagaacaaagctggaggcatcatgctacctgacttcaaactatattataaggctatagtaaacaaaacagcatggtactggtaccaaaacagagagatagaccaatggaacagaacagagccctcagaaataatgctgcatatctacaactatctcatctttgacaaacctcacaaaaagaagaaatggggaaaggattccctatttaataaatggtgctgggaaaactggctagccatatgtagaaagctgaaactggatcccttccttacactttatacaaaaattaattcaagatggattaaagacttacatgtcagacctaaaaccataaaaaccctagaagaaaacccaggcaataccattcaggacataggcatgggcaagacttcatgtctaaaacaccaaaagcaatggcaacaaaagccaaaattgacaaatgggatctaattaaactaaagagcttctgcacagcaaaagaaaccaccatcagaatgaacaggcaacctacagaatgggagaaaatttttataatctacccatttgacaaagggctaatatccagaaactatgaagaacttaaatttacaagaaaaaaatcaaccccatcaaaaagtgggcaaaggatatgaacagacacttctcaaaagaagacatttatgcagccaacagacacatgaaaaaatgctcatcaccactggccatcagagaactgcaaatcaaaaccacaatgagataccatctcacaccagttagaatggcgatcattaaaaagtcaggaaacaacaggtgctggagaggatgtggagaaataggaacacttttacattgttggtgggactgtaaactagttcaaccattgcggaagacagtgtggcaattcctcagggatctagaactagaaataccatatgacccagcaatcccattactgggtatatacccaaaggattataaatcatgctgctataaagacacatgcatacgtatgtttattgcggcactattcacaatagcaaagacttggaaccaacccaaatgtccatcaatgatagactagattaagaaaatgtggcacatatacaccatggaatactatgcagccataaaaaaggatgagttcatgtcctttgtagggacatggatgaagctggaaaccatcattctcagcaaactatcgcaaggacagaaaatcaaacacagcatgttctcactcataggtgggaattgaacaatgagaacacttggacacaggaaggggaacatcacacaccggggcctgtcatggggcggtgggagtggggagggatagcattaggagatatatctaatgtgaatgatgagttaatgggtgcagcacaccaacatggcacatgtatacatatgtaacaaacctgcacgttgtgtgcaggtaccttagaacttaaaatgcaataaaatatatatatataaaatatatatattttatatatttttttaatatatatattttgctgatgtaagaagaaattttatatacatatatgtagcaggtgatctttatttacagataagattacataatttgaaaatccaactttaataaaaaatccaactctaataagagaatgtacttagatacaaagatgtaagacaaatatacaaagaaatcattagttttctctgtaccagagataaacagctagaaaatcaaatgaaaaatattttataaaaagtagcaacttatatcaaatgccacacagtataaatttaacaacaaaatatatataaactctatataacaaacagaaaatattattgaaagatataaaataccatatgaacaaaaagataaacatatgttcctgaagaggaggttactttcttaaaatgtcatgctttctaaacttaatacatacatttaattccatatattccaattagaatccagtggtattttttcttctccaacttggtaaagtaagtttaaagctcatttgcaataatgtccatacagaacagtaaagaaaagtgtgcaaaagaatagtgggagtggaattgtcttgccagataccaaacttactacaaaccatggggaaaaagaaaagaaaagagaatgattctagaacagggacagaaaagttgaacaattaaccagatagcacagaaaaaagccaagtgttatgataactttaagccaagtgttaaatcactcaattgtgacttttcaattgagtggggaaaagaaccatttgtataataaaaaggcattagcatatgtgcatctccacctgtggaaaaaagaaagctggattgtattacctcaaagcatacacaaaagaatttctagatagactaaatatctcaatcttaaaaattattcaccagcctgggcacagtggctcatgcctgtaatcccagcattttgggaggctgagggagtagatcatttgagcctatgagttcaagaccatcctgggcaacatgatgaaactacatctctacaaaaaacacaaaaaaatcagccaggcatggtggtgtgtgcctataatcctaactactcagaaggctgagacaggaggatcgcctgagtcaagggaggtcaaggctacagtgagccatgatcctaccactgtactccagcctggcaacagagtgagaccctgtagcagaaggaaaaaaaaaaaaatgtgaaaataattatatagctttgatataagcaaagatacccacgacaggaaacccacagggcattttttaaaaaaacctacatagtcatattccagtgtaaaaaatgtaaaatttgttagtaactgaagtcaagagacaagtgacatcctagcgaaaatatccgtaaaatgttgaacaaagtgttgatgtcacaaagaacacctataaatcgataaggaaaagaccaaaaattcaccatgaaaatgaaaaaatgaatagtacacgtgaatcacaaaaaaggaattgcaaataaccagtatataaaatggtcttcaacctcaagaacatgcaaactcacgttagttaacactatttacccagtagattggaaaaatatttcatttcaagcatttcactggtaaaatacattgtgggtgaaattataatccattacaaacaatatttcttggggaaatttggcaacaccttctagaatataaaattcacgtggccttgaagaaaagaaaattctactttgaagagccttttcagtcaaaataaaagggccagtgtgcaaagctgtatgcactagaatgtctatcgcatattttagtgacaaaaaagtaaaaatactgggtccattaatggggcatgactgaatatatcacattacagccatttctacggaacataatgcacacattatgcaaaaaaactgtattttgctgcagtgagatgtaatatagtatacagtagtaagggctctagaggatggaagcccgacagcccattccaagtctgggcttcaccacttcctaaccttgtgaacttcagcagcctccttaagttctctggacccgtttcctcatcagcaaacagggagaatgatagcaacttcacaaggttattgtaaggctcaaatgagataaagtatttaaagcaaaaaaaaaaaagtgttcttaaaatcaatttcaagaaaattaagtcacaaagtaatgtctgttgtgggattccttttttgtcaagataacagatcttatctcacttaccattgcctgaacaaaccaggacattgtccatctgggatggtttttgtccaaacaggaggcgatagttattaattaaggaagcgagactgggtttggactgtggcatacgacgagaggatttggctagttcttagtaaaaggagaccatagcaggcatgcagcattatgtacagatgccctaagagactgagaaacaaggaaaatggggttggaggcattttgaggggaggagcaagtgtgagcatgagcccaaccctgagatccttcaagagcccagttctagttgcaggccacaagtatcctgacaataaacgactctgtgcttcttagactctgcaaggggaagacttatcaaagccacctcacaaaaaacagagtcgttaaatatatactatgtgttttttttgtttgtttgtttgtttgttttgagatggagtctcgctctgtcgcccaggctggagtgcaggggtgcaacctcagctcactgcaagctctgcctcccgggttcacgccattctcctgcctcagcctccccagtagctaggactacaggcgcccgccaccacgcctggctaatttttttttttttttgtatttttagtagagacggggtttcaccgtgttagccaggatgatctcgatctcctgacctcgtgatccgcccatctcggcctcccaaagtgctgggattacaggcgtgagccaccgcgtccggcccatactatgtgttttaaacacaaaaaacacagtatgtatttaacagacgtcaactgcgctgtgccagttcagctaggctaggcttctgcctgtaactgaaaaacaaactagcatttcaagtaaaatgagtaaaaaatataaaaacacattgtaaattatcattttctaatacttaagtcagcttatgagattcctcccacacctactcagtggctcacaaaccctcggaaggaagaagcactgcataacccatctcaatgtttcagtcattacttaccacttcaatagcccactaataaacagtggtttccaccaagataaaatatacaaatttttcaatagacgtagtaaatactgaacaaaagtaaacagaagttgactataatatcaaaaagcagtaccatttagtattagtctgaaagcaactagtgaacgcattaatataaccaacaaacaacctttcacgaaatacttagagattagggccataaactacaagctagtgttcttttcactttgaaatgaaagatcagaggttccatataggccttaattagactcatagtctagaatttttctttctttctctaattaagaggatcacgcaaaaacactgaagtagtagtgccaagatgattccagccaggtagcccagtgcaacacacacaaaaatagttcacagagataatgttacccaattatgaattcagagagactcaatgtacaacatatttcttaagacacagctacaagacagagagtagggcatcatccataaaaggttgggcaaaagatgagggcctcaaagccaggccaaactgggtggtttttcacctagaataatataaggtagtctgcctagaggaacaatctctatcactgttgaggaagaaagccaaggtatataaatgaagaagaggttctaagtgtcaggtccaacgtaaatggtgaggtcataaaaagcaaaaggaatttctaggccagacatgatgaagatgagaaattaaggggtatgaagataacaaattgggtctttgtaagcaggttagaactaaaatggtgaacgctgagactgccggaagatttttgttgtgttgtaccagttggatagtgtgtttgtttgattatgcaggtgcacacatgtatataaacaagctgggaggtagcgagctcctcccaagaggaggtgtaagtttcatggcttaaaggagtcaggcaaaaccaatgttccacctaatattaactatcaaattatattttaatattgtcccttactgaataacaattcaggattgcttgggaccaatagtaaactgattgaaaaaattatccaaatggggataagctatgaatgttactaggatcatatgatgagaggtaaaaggatgggcaaattcaaggctacagacacaacttgattcagaaaatatgaaattacgaagaggaagacataccaagtactattctttggaaagatgagatgtttgttaagcagagcttaatattaacttctttttttttcttactcctttttttttttttttgagacaaggtcccactctgccacccaggctggagtataatggcgcagtcacagttcactgcagcctccacctcccaggctcatcacctcaacctcctgagtagctgggaccacaggtgtctcccactatacccagctaatttttatatgttttgcagagacagggtttcaccacattgcacaggatggtctcgaactcctgagctcaagcaatccacaagcctctgcttctgaaagtgctgggattatagacatgagccacctcacccagccaatattaacttattttttaatataacagactagggagtaacacagaagttggtcctcatatctaaaacagagtaaaaatactcttgactatttacattcaaataatgtaactaagactaacatgagtcactttccgttttccaatcaatttatagattaaatgcttatacctgacaccagaaaaaaatagcaattaaactgtaggccataaaattaatttcttctgcagtacaaaaaaaaaaaagaaaaatgtaatttcatttctttttgacctagattatgccaattgcattagatgttttatttcccatatgtatcagaatgttcaaatagtatataggctactaaaaagaatcattcccaaatggtactctccccaaacaacaaacttctcttattaatcatgctgaaactgtatgcttacaaaaaaagtgagcaaaattggaagcaagagccttccaaaattaaatgaccaactaaatcagataggcagatttgaatgttttttaatcaggcactgctggcatgatcacaacatttaaaatacccaaatgattctacataaatctaactcatcatctttcttacaaaaagtccagagctctaatgaagtccataatgatctggataaaatacacttaattagattataaactgcaacataaaacggctgcatcatgccttttaacatttttctctctgaagatcagaggattgaaagggggttataaaacagcccattcatttttcttgtcttttaaaggaaggaaaaaaccattaggcagaactaaagttccagacaacttttaacaagtgacatccaagtaggtcacattcttagacctcctcagagatgcagggaacgatgatggggtcaggtgaccaacacatcaatgggacggcatgtgatcagacaactctggggaatgctaatgatttcctatgtgatgctgatagtacaagatgtactttatgcttgatgatatctagatgagatagataacaggaaaaaaaaaccaaggctaattaaaatgcatttcaaagataatcctaacatgattttctaatagtacgcaagtccactgtgagtttgagatggtgaattaaagacgaatctattcatccacagatacatctatccactcatacaatttatgtgtttatttttggttgagggagacaggaggtgagaaacaagcatgcaacaattgctaaaaatgtctttaaatatttatctacagaattctcaaatgtgttatcttgactactagagactaagagcatggcctttggagtgaccagatctcctttgaatcccagttccaacatttgttggctctgtaacgctcaggtgcagttatgacatctgaacacagtgagaacaatccatgttcaggaagtaattatgggagattaagtgtaaggcactttgtactttgcctgtcctagaataggtgttgcatacattaaatcacaatcaaaacagacaagcacatttgggataaactaaataagatctctaaataaatgaaagggccagcctcagtggctcacgcctataatcccagtactttgtgaggctgaggcaggaagatcgcttgataccaggagttgaagaccagtctgggcaacatggcaagactccatctctaaaaaataaaaataataataataattagccaggcacggtggtatgcacctatagtcccagctactggggaggctgagatgggaggatcgcttgagccctggaggtcaaagtgagaccctgtcttaaaaaaaatttttttaaaaaaagggacataccatgttcacgattcaatattaagatgtcaaatctcccctaagtgatctacatttcacaccatttcaatcaaaatagcaggctttttaaaaagctaacaagctgattaaaaaatgtttatgaaaaggcaagtgaaaatagccaaatcaattttaaagagagaaaaaaaaaagttagagggcatacactacctgatttcaagatttactaaaaagctatactaatcagaatggtgtggtactgaagaaaggatagaatagtgagtccagaaacaggcctacacaaacatgggcaattgatctccaacaaagatgaaaaggcaatttaatggagaaaggaaagtctcttcaaaaaaatgatgcaggaacaactgtatatttgtgtggagaatcaagaaaacccttatgccataacatattcaaaagttaattaaaaatggattatagttgggcatggtggcaaatgcctgtattcctgctactcgagaggctgagacaagaggatcgctttagcctgggagttggaatccagcctgcataatgtagtgagacccgatctctatggaaaaaaaaaaaagattataaattgaaatgtaaatgctaaaacagaaaactcctagaaaatatttgtgactttccctaagaaaatatttcttaaataaaagaagaaaacacaaactataaaagtaaaaattgatcaaatgaactttattaaaattaaaaacttcggctcttcaaaagatgccattaagaaaacaaaaagacaagtcacaagtaaggagataatatttgcaatgcatatctgacccaggacttgtatccatgtcatataaagaactcttacaactcaacaacatgaaaacaacccaaaataatataggcaaaagattgaacaaatacttctcaaaagaaaagatacaaatggcaaaaaagcacttaaaaagataagcagtagcattaactaattagaaatgggaattaaaaccacactggactgccaccgagcacgtattagaatggctgaaattaaaaagactgacactaccaggtcttggtgatgatgcagagcaactggaactctcatatactactggggggaacacgaaaagtcacgactacttcagaaagcagtcttgtagttttttataaagttagatataatactaaccatataacgtagccactgtgaccacagatattttcctaagagaaaacgtatgtcatacaaagatttgtacatgaatgttcacagtgaatgtccatcaggaggttaatggataaataaaatgtggtatgtctacacaacacaacactattcataaacagaaaggaatgaattactgataggtccaataatatgaatacatctcaacaccattatgctaagcgaaaacagttggatgtaagggtacatactgatttcactttatgtaaaatgcaagttgatgtacagtgacaaaaaggagatcactaatcagctggggctgggggtgggtgagggatagactgaaaaagggtacaggtacaaagaagatatatagatggccatttttatgcacataaaaagatacttaacattagtaatcattaggaaaatgcaaattcaaaaccatgataaaataccaccttaacactcattaggatgactataaaaaaaaaaaaaaaaaaaaggccaggtgcggcggctcacgcctgtaatcccagcactttgggaggccgaggcgggcggatcacgaggtcaggagatcgtgaccatcctggctaacatggtgaaatcccgtctctactaaaaatacaaaaaaattagccgggcgtggtggtgggcacctgtagtcccagctactcagtaggctgaggcaggagaatggagtgaacccgggtggcagagcttgcagtgagccgagatggtgccactgcactccagcctgggtgacagagcaagactctgtctcagaaaaaaacaaaaaaaaaaacaaatgttggcaaggatgtagagaaactggaagccttgtgcgttactggtaggaatgcaaaacggtgcagctattgtggaaaacagtctggcagttccttaaaagactaaacacgagctgggtgcagtgatacatctgcagccccaggtactcctactctgcaggctgaggcaggagactcatttgagaccaggagttcaaagccagcctaggcaacatagcaagacctagtctttaaaaataaaagaagacaagaaaaaattttaaaaaataattactatatgatccagcaattccacttctgggtatataacctgaagagctgaaagcacagattcaaataggtattggcacacctttgctcgctgcagtactattcacaatagccagaaggtggacataacccaaatatgcatcaacagatgaatggagaaatcaaatgtggtatatacatacaatgcaatattattcagccttaaaaaggaagggaattctgatcaatactatcatattggtgaactttgaagacattatgctaaattaaagaagttagacacagaaggacaaatattgtacgattcaacctatagaagtacctagaattgtcaaaatcagagagacaggaagtagaatggtggttgccagaggctggggcaaaaggggaatggggagttatcatttaatgggttcaaagtttcagttctggatgatgaaaaagagttctggagctggacagtggtaacgggtgcagaacaacatgaatgcacttaatgctactggattgtatacctaaaagtggtcataatggaaaatttcattatatatacattttactacaataaggaaatagtaaagaaaaaagtggcacagaaatattttggaagtaatggaaatgttctctatcttgattgtgactgtggcttcatgggtatataaaactgtcaaaattcatccaattaaatagattcatttaactgcataaaattattgctcaataaagttgatgaggggaaaaaaagacactagcaaattagcaagaatatattttatgcctctcctccctgcctttcctcatttcatcctgcaatgcctaccagttttctatttcataggaagcaggagaaaaagaaaaaaacggagggagtgcgggcagggggacattcattcaacaaatacttagataacctccatttcatatgttactccaataagcctgagtgttacaggtttatggatgaggaaactatatgaagtttggtatgaagtcgtttatccaggtcacacgagattaagtggcaaagctcagtttgtaaccaccgtgtttctaagccttcacaaatgtgcattgtaaaaatgttctccctacgtgtgatttcaccagacctacatacatgaggggaaataacaagaggcaaagccatgaaaattgtgcactatcaacaagataaaaagtgtggcaaaaatgataaatgttcaagctgatggatatgctaattaccctgatttgatcattatgcattatatacatgtatcgaaatatcactctgtagcccataaatacatgtaaactaaaaagaaaaaaaaaggacataaaatgtgtggaaaataggtacttctgttcacatttaaggacttcttgcaaagagttattgaaacctttgtcttttgtaatttctccttacttaacaattgggcacacagattaagaacacacactccacagtcacacttcccaggtcccgtcctactgctgtgacctgacgtgatctccctttgcctcagttttctcaactgcaaaatgcggattataattgtaactatctgggcacagtagcacctgcctgtggtcccagctactccggaagctgtggtagaaagatctgactccaagttcaagtccatcctcggcaacacagtaagacattgtctataaaaataacaataataataattgcatctacctcaaagggcttttgtgatgattaaataatggatgtgaagtgcttaacatagcgttagaggcatacgaaattctcaataaatattagccttcctcttccatatagtctacctataacagctatggtctatctgtaatagctaggtacaggtagagttacatgcagaactgaaaaagaaaaagctacttttacaggtagtggtttgaattcactaatgttgtccttccttccttctttcctccctcccactctctctcccttaaaatgcattgctgttcctcaaatatagtttttgcattaaaaatgtatgatggatacagatggcaaatacgcatatgaaaagatgctccacatcacatgtcatcagggaaatgcaaattaaaataacaagaagataccactacgcacatattagaatggccaaatccggaacactgataacaccaaatgctggcaaggatgtggaataacaggaactctcgttcactgctgatgggaacgcaaaatggtacagccacttgggaagacagtttggcaatttcttacagaactaaacatactcatcacacaatccagaaatcttactccttgttatttacccaaaggagttaaaaacttatgtccacacaaaaatctgcatgtggatactgacagcagctttattcataactccccaaacttggaagtaacccagatggccttcagaaggtgaatggataatcaaattgttgcacatccagacaatggacaattatttagcactaaaagtaagtgatgttatcaagccatgaaaaggcacggagcaatcttaaatgcatactactaagcgaaagaaggcagtgtgaaaaggctgtatgatcccgattatatagcattctggaaaagataaagctatggaaacggtaaaaagatcagcggttgccagggatgagagttgagagagagatgaacaggtgaggcacagagcacctctgtataatgccataaaggtaaatacatatcagtattcatctgtccaaacacggaatgtacaacaccaagagtgaacgctaacagaagctgaactttggtgataatgaagagtccatggaggttcatcagctgtcacaaatgtcccactctggtagaggatgctgagaatgagggaggctgtgtgttttgtgttggaggtgggggaggagggcaggagggatatgagaaaactctgtaccttcctctcaattatgctgtgaacctaaatttgctcttcaaaaatcatctttttaaaaaacatgtatggtggaaactatgaatgatgaaagaaaaccccattcagtaacctgaagcagcacgttatcttacgaaataataaatgattcatttatctttggcagaatcgggtcattttcctgcctttctctttctagggaaataaaaattttacactttctcaaacatttggaagattgtctttcaaaagccagtacaaggaagcttgaggaaagctttttatagccaagtataacagctggcagtctagaagccatatacaacattttgctgttctacagaacttatagcagctcacaaaagcaaaaccatttttattgaggaaacaataaaaattgttggaaattttcaaaattaaatagtatagaaggacttttattgtaataaaagtaatctatagataatgtttctcatagttaacaaaggtgcccatttacctactcaaatccacatttcttttttttttttttgagacggagtctctgtcgcccaggctggagtgcagtggcatgatctccgctcactgccagctccgcctcccgggttcacaccattctcctgcctcagcctcccgagtagctggaactgcaggcgtccgccaccatgcccggctaaatttttttgtatttttagtagagacagggtttcaccgtgttagccaggatggtctcaatctcctgaccttgtgatccgcctgcctcggcctcccaaagtgctgggattaaaggcgtgagccaccgcacccggcccacaactccacatttctaatggactgcaaattcaccagcggtaaaagtaaacgagggaggcaatagatcctttgggtctgatgttacagccaactcaagtggcaggcttttgctagattttctaagccagcagaggcagggataataaaacacatttacctagagaaaaaaaaaaatcaaattaagatgactttaagtattctatactaacagaagaactattaaaagtagttaaatccattgttctgaaaaactgaacagagatatgaccaactggaggtgttttgtctctctcgactccactggcactaggacctttttctcctattttattatcaagcatggtgagccagccattgccatgcccaagtgctgcatatcttgtgagtctaaactgaaaacaacatatctcagacgttatcttagacttgaggctgaggaacagatggatttaagaaaaaaaaccattcctttccttttaaaaggtcttaaaaacttttgagaagcttcaggaaaaaggcaagtaagatacgattattttgtggcataataagatttcattttctgaaactcaatcaggagaactaatgaagaagaaatgtgccccttgcttgtggaagccagcttaaactggtaagagcccaatcactcacagtatttgttaagcaaaatccatttatgttggaacagtaggcatttaagcattaatatgaaagttaaaatagagaagacagtacagaatacttaagttacaatttcaaattcgacagtgttgacagagctactccagagaccactaaatatattgctttaaaaaaaaaagttggcggggcataatggctcacacctgtaataatcccagcatattaggaggccgaagtggaaggatcacttgagctcagactcaggatagaccagcctgggcaacattacaagaccttgtctctactaaaagaaaaaaacttagccaggcatggtggcacacatctgtagtcccagctacttaggaggctgagatgggaggatggcttgagctcaagaagttgaggctacagtgagccacgattatgccactgcactccagcctgggcaacagagcgagactgtctcaaaaaataaaaataaaggttgcgtttttttttttaaacattatatatctgagaagatctccatatataaatatttcattttaaacagctaattgaaaagttccatacatttatatgtgagaacatttcataaggttttaccttatcctaatcatatcttaactctaaatattccgtttaacgacaaaaatggcataacattcccaaagcagcaaaatgtctttcttgatttctgaagataaaaaaggaaaaaaatagaaaaagcagaaaagcaataaactgttattcattttaataaatttttatgatccctcagtcattactaaattggatcatatgataatttctcctttggttatcatttttattgacaagttttcagctgttttttcttcatttgcaaaatgagtcctagatctcatgtctggcataatcactcagctcccataaagaaagacatccaggacccactttatcttcatgttacttttctaagccagcccatcaaaagtctgaggagacagtcactcttactgctactgacaataccaactggtttagtgtacactaactggctgactacacacatctattccttttcattcctaacagaatgctgattttattcacatattcattctcattagaaataaatgttttaggccaggcatggtggctcacgcctctaatctcagcactttgggaggccgaggcgggcggatcatgaggtcaggggtttgagaccagcctggccaacctggtgaaaccccagctctacaagtacaaaaattagccaggcgtgctggcaggcacccataatcccagctactcgggaggctgaggcaggagaacggcatgaacccaggaggcggagcttgcagtgagtcgagatggcaccactgcactccagcctgggtgacagagcaagactccgtcacacgcacacacacaaaaaagaaatgtctcaagtgcttaaattcttgtaaaaataactgcaaaaagatatatgagtaaggactggtaggtaccatatgactatttcagcaaacacatatcacctggaaaaaatgtgctgatagagtttctttaggatcaaatgcgtggtagggaaatccacatcaagtccaataaaatggtaaaagaaaaaaagaaaaagccaggcacagagactcgtgcctataatctcagcactttgggaggctgaggtgggaggatcacttgaacacaattcaagaccagcctgggcaacacagcaagacgccatctctacttaaaaaaaaaaaaagaaaagaaaaattagctagtcatggtagtgcatgcctgtagttccagctactcaggaggctgaactgggaggatcgcttgagcgaggctgaggctgctgtgagccacgatcacatgactgcacccagcctgggcgacagagtgagaccctgtctcaaaaataaaataattttaaaagttaaagctaacaaaatatacacaaaaacccagaaacagtgatgtgaaagaagcttttgattcgttagtgatgaaatgagagctgccttgatagaccggcactattacaaagacgtgcattgcctgatcaagaggtggtgcttctcagagtttctaaaccaaagattgaattcttatttttcttcatggagggaaaaaaggccacaacgttacaatataaaaatctgaaaaagggaagtgaattgatttttcatctaacttaataaaatgacttatttggctgatatttccttaggatctcaacaacctcaagccaaaacttcatagtttttcagggcagcacaaacgaatcccacaggttaaatgaagagctgctcattaggactgagaatcaggaaagagccttagttcatccacatgtgattcattcacatcattgacttaaagatcgtcaccattcattgttcctgagtggggagaaaaaaatccacagaatatttccccgagatcataaagaggttagtcactgatttggggatctttatagtctaccatttgacaatgacttggcctttctgcgagaaaaaacatccatcaggagtaccactgaaaatgtgctgaatttagagcacctctccacagtgactgcaattacagaactcctaaatcactgaaaacactctgaatcttggttttaaacatcttgtgacaccagaagaggacaaaaattgtcctagtgatgatgaacctaatatgtggtgtgtctgttttggattacaattttcccaattacaaatgctagtcatttggaccactaacccaagaatgccttggttaatttctcaaggacaaaatgtttacatattgatatattttaacatttcatttttgaaatgaatgctattttatttttcaaaggcagatgatgtcttacctacccagtgtatttataacccctttgaacacttgacccatattcctaagcatccttatggcacttaaaatgcctaaccagttccaaatgttcaataacgtttcagcaaatgcttgctgaatgaattaattaatgagcgaaggtatgttgaaaaaaattagattttcctggtaacttaattttgaaatagaaaacatataataataaatgctagctcaaaataaccctagtaaagcaatataagtgactaccttggaaaacttacagcagaatgcatcactgctcccactcccaaacctgctaccacttttgcgttctttatgctatgagaggtaccactacatccacagctgactgcatcaggaagagcccaagaccaccttcagtttcagttatctactaggcagactctcagggctcggcacacagtcgtactcacagctgcagtttattacagggaaacaacaccaagcgaagtcagcaaggggaaaggcacatggggagaagtctgtggaaacagagtgggagcctccaagggccttcccccagggagtcacaagggaggcacttcactcctcctacaaaaagctgtgataacgtgagaaatgtcccagtcagggaaacccattagagactcagtacccagggtctttattggagttcaatcgcctgtaggcagcctctaattttggactcctggaaggacagcaggggatcagcataaaccataatgttgacacaaacagtttaggcactgtcagccactcttaccagataagggggaaacacttgctgaaatctcagttgctaaatgtcagccaagggccaaacttgtgggcctgcccttccttcctttcctccttccttcccttccttcccttccttccttccctccctcactcccattccctcccctcccctcctctcccctccctctccttcccttcctccctctctccctccctttctctctctctctcttaacagtcttcctctgctgcccagactagagtgcagtggtatggtatcagctcactgcaagttccacctcccaggttcaagcaattctcctgcctcagcctcccgagtagctgggattacaggcgcatgccaccatgcctggctaatttttgcatttttagtagagacagggttttgctatgttccctacgccagtctcgaactcctgacttcaagtgatccacccgcttcaacctcccaaagtgctgggattagaggcgtaagccaccacgcccagcccaggtcttttcaaggataagcagtttaggcctgctaggttaactcttttctgcacagcgactaggccagaaaccaagaaataatcccaattcctacttcttcactgtccctcatctcttctaggccaaatcctgtcaattttgctcctgagtaacttccctgtactcccttcttcctgtcctcactatcgggctttaatggaggcctctgttctctcttgctcgcatcactgccggaactcctaccttgtctcctgcctatccttccatccattctccacaggctctttgccgggaaggctgcccactgccctcaacctcccgagcatagtggaaaacagggcctttttctgatgtgcccaagttttctctctaatttctcaacactttctcccttttgtactctctgttctagtcaaactgaactattaaatgcagttctcagaaagcatggcactttcttacctttgtcactttgttctggctacttgtcctctacctagaatgcatttccacttttgcctgggttaagaagtatgtaggctttagaagtcagctgaggcaccaacacaaatcttccccagatatccccgtctcccagtctaatacctcatgcctactcccctccacggcatttatcccactgcactgcaatttcagtctattttattgatctatcccctatactgtgtgtccttaaaggtgggactgcgtatccccagtgtctagcatggtcactgacaaattgttcatgtccaataaatacttcttgactgaataaatgtcacaacttcagcagggttcccctgaggtcagctccatcccccggccttctagaccggactgaacttagacgattttggcacagacactgggaaccgtgcatcgttcatgttatcctctttgcattggctttgttcaaaagctaacagccaaatatgtggtggtcttcctgtgaccgtgtaggtctgcagagcctataatctgtatactaattacacttttggtttcgacttaccttccccaacctcttactctgattacttcacttacactttatttgtatctttgtgtgtgtgcatggttttttccaaagctgaaattccttctggactaaagcaggatataaatagatatgtatatagtcccaaagagatgagaacactgtcccattgtttagaggaggtgaaacctcagtttttctcagtatcccattcctagctaaatccaaagtctcctaaagcacaacttacaaaaagagctattttcctcctagttcttcagctcaacttcatgcaatgaagttactctaaataaaggaatgcatacgtgcacccatattttcttcacaagacttaggagcaagactcaaaaaagtgaggacagatgcgcgccttactttatccagtcaatgtgctgctgaaaaactgggtaaaatgagttgtttaaatagaatcaaaatgtcagtttactagagatgctcactacttacagaaacaccacggcaaatccatgaagtaattatggggtgaaagaagtaatcaccctaaaacttatctgccttgtaatcccagatttacaggctgaggcaatgttaaagtatgcttattagaaaaccctcaagttctactgtgtataaacatgcaatcctcttcgtttgtttcatcacctataaacgtaactcaagttaataaccagccagaaaattcaaattaatattaaatactgaaacactgttatcaccaaattcacaccagaaattattagcacttcaaatgtgagaatgttctcaaagccctgttaattccttccttctacccctacttgacagacattccttgacaacctcctaagtaaaacattccttctctacatgtcaatagattccacctaagaaaggcaaagtccttgctgtcaaggaacttatagccacgtagagttcactctttttgttatatctgttactaacatgagacttttttcttctttaatccaaattttcatttcatttttttctcctttacatctgtttttgttgtaaactgccactcaggagataactttcattaatttgccttataaaatttctaccaaaaccaactaaaaggacaagagaacatagaagaaggacagtacatgcagagttttaaaaaccttaaggaagattaaaagctcgtcaccacataaatgtctaaagttattactaggccctaccaatttgaactttgggatgaaaactccttatgaattcattacagatttgaatttttaaggcaattcagttcaactcatctcaagtacgaacacagtcattcaaaccgggctaataaaaggcagcttagtggacatcctaaaaggttgaattttcatgaattaacagattggcaacgagcttctcaacaatttggatgtaaacaagacatttagaaagctgctgaaaactgtttcttcatgtaggttaagaattagtcttccaatattttttacattacaattcttatttttcaaatttttttttacaaacagtgaaaaggtagtgtgtctaaaattctctgcactgctaaataagtacagattgaaactatcttataaatgaatttgacaatgacctgtgacctagaggcaaaagcagacagtgctgtttaagctgctcagtaaaatttgagctaaactcgaaatgtagaagcaaatactttctagaacacctgatagatcaatgttttaaaatccttgctaattgcttaagttttcattcttttgtaatctgctccttgtgtgtacttaacctactcacaggtatttatgttaattcattagatccctcagggtgggccgggcagactattatctgaaagcactggtgcatagcttcctgggtcagggacaaataaatcttttcatataattgcatgtcgttttatgtgttgctgtcttcccactgggaaaaatgttaaaatatttaaggcttactatctggtgtgattgtgattttataattaaagtctgggacaggaggagagagtggcagaattcagtactttatctcagtaggaacagtctttctttgaagcggtaaacttttagatagtcaataaaagtaaaaattccggtgaataagagctggtagagtccttttgaagtcacgtaccaccatttgatgacaatctagtttaataaagatagagctaaaagaataagaaggactgtatatgtcacaaagatcgtgattctcttcagtgataaaatcaagtaaatattgtcatcaagctaaaatatacccaattctaatacagcaactgtttacctatttccaaatttgtctacataccagacagccagtgggggagaatggttttattttgttcttaattagaacagtatttggagctggaactatctaatgggcaagtaagccaagcattctctcatccactcactcccttcagcattcttctcttacccctatcttctggaccaaaaaataaaaagtctagtcaggaagtggggagtgggagttgcgggacaaggtatgagttggggagagcatctgggttttatcaccaggtgtgtcaggatttgcagtttcttgaaaatctaaatcttcaggttgctgtgcagacttgtgcctcctggtacaaataatagctgcgcccacacacactaatgcccccccacagcccacagccttggggcgctccaaggagagtgagttcaataccagcagtaagggcgactcgctcctggacgtgaatctagcatgcaagatcattttcattaaacacgtaactgcacagcgacgatttacatctcctcttatttcctttgaatgagaagcagacgcataacagcaatctggaatagaaagtggagcttttacaggctgttgtatgtgcaccaaggccgggagaggctgaggtccgtcagcatcatgtggcaggaaaaccgcaaatagttcgaaaggccacactctccggcaccgactgagtagctgctgcaggaagggggacaaatggtcctcagcaagaccctcttcagaaggaacaagagaccgtgtggagggcccatgagaatgaatttgtggtttgcaactggtttgtcatgtctcaaaataagtaaatccagtatgtgtgactgtttagaaaagcagttaagggcggttgagtctttcttggttaattaagtgattttcatctggaggtatgtttggaggaaggagcctcctggaaagtaggatcagaaagaagtgtttagtgtgaaaaaatcagttccagatgattttgtgtatatgcctcgtgtttaaattcagactgttaagtctagacactggaaatcaaactacaggtcagcaaaaaaaaaaaaaaaagaacacccacgcagcaaaaagctgtcatttcactgccacctctgttaaaagggtacaaatatgctatgcttgcttcaaatctatgttttataattctcttctttataacaaaaagtcttctgacaacacaatcaaaaacgaatagtcagaagtaatgatgatctaaacctaaatggttaaagtctttgctgatggatgcagagctcaggagggaggctatgactgggagggggcagaaaggctgagggaagaacaagaacatagagacggagcgcagggtgcctgcaacctgctaccagtcaaacccctaccacagtttcctcatctcgacaaaaagcataatcaggtacatgagtttactgttcataataatgaactacagaagcatttgttattgttacactaataaaaaccacaataaaaaatactactcttattagtaacaaatcaaagaacctccttaatatgaagtcagtgtgaatggttcttggaggggagccagttccgcaggcataacagccatccttttgcaaagccatcaatccagaattaccagtcatacctccaacttatgccttaccttaccccttatgtcttaccttatgcttctgctgaaaaagcgaatgaaaagctggtctcccttttcaaaaatgaaaccatcaaaaaccaacatgggaaggagaagaatcactgactaggatatgtctgtgcagaaaacaaggtggctctcatctgaaaatataacatgacaaaggcgaccaactacatagaacatcatttagattctctccaattttgagatgctgtagctggagcacagagataaccgcccccagtcacacagcctgtctgcttctggactctgtattcttagtcatgaccttgtagctgccttatcatgttctaccataaaaatgaaaattgtgaaacagaaaatctaaatcaaaatgttttaatttgtaataaaagaaaacaaactgagaatctgcaaaagttgtgaaaattttcttctgtgtgaggaaagcttcgtgccagatatcttaaactcaacataaatatccaacacatttcacataaaacagaacaatactgccatggtaatgacgctcctcagttagacaaaaatctcaagagcaggcctgtctgctgatgttcatcactaacctacagtgtatgtgcatttgtttttgccaataaactatgctgttgccagagattaaacataagttcctaaatgcatgtatgattgtttgtaattacttaatattaataagccgaactgataaacacaatcccaaatcaagaaagaaagccaacataaaacagaaagatggcattgctaaatcccggaagacatcacctcgagcttttcatcatgccactttgaagttcacccccatccaaaccctttgtggcttcctctgaagaatcctgaggcagaggcagcagcaggctcactcctccagctgcctgcgaaggctgaattccatttattccatttggggttggtggtgggcaggacgaatgagactgttgtcattcttcccaggaatgcttagatggacagtgagctattggactgccccagataccatcatctcccccacatccctcctacgtggagccttagtttggggggaagtgaatctcaattgcccccttccctctccccgtcaatgaggcaggcttgtggaggtgctggccacttcttaggcctaaatctgtgttcagagagtggatccatgctttgagagatggttgccctgcccgtcctagactatcttgaagggtgagaggcacaggaacttagagagtcaaagactaccaagagacacaccgaaaactagtgaggtgggaactggcaatttctaaacctacggcaacagcagtctctggtccttcttttcatttcccgggacctccatcctgagggctgaactgataacattcatcttacttttatggatgatgaggaaaatgccacaagtgagtttaattctcaaaggagaaagagaaagtggtatctaatatcgattaggtccaaatatactctcttggtgttttagccagaaatacatctgggcatttctgcagcaatctgtaagagactttatacacgtatccatctcaaaataatgcgcttttagttattagcttttattcatttccattttgtctttttaaagtgacatccaaaatgatgaaaagcttcagggtactacaacaccataagataatcttcctgtattcacttccccaaagtacccagagatgggccccaagaggagtcctcctcacgaagaggtgaagcaccgacctgaggatctgtcagaaccctgatcaaaaagcaacagaacaaagtgaatggcgagataaagtggagagggagccattgtgtttacgttcacctaagcaaagtcctaattagtgcccagtcctactggaggatggttttaatggcatgcaccttttatcgcctgcaaatgcttaagggtcagcagaacaagccactgccttgttagataatgaaacacagataaaaatttatgtgtaattggtatgttttaaactggtatttaaaagctatttatctcttagtggggacaaatattcttttaagtcattaattggcaaccataaattttaattctattctaggcataattattacagatttcaagtaagtaggctccaaaacaatgaggctttactggttcgatcagaaatacttgttgaagggtttcctaagaagattacaataggataaattaattctatcagcagaagcactggagtatagaatgtcaaatacagtaaatccatatgtaataaacatagatatctaagatgtgtaagtaagtaaaaataaggatgttgcagatatatatacaatatggtgctgcttatcaaaacaacacaaaacaattttttgtgtgtgtctgtaaaaaaaaattgtgggagtggggatgtgtaatgctgaaggtgaggtgccaaaatgccagcagtggctacttctaggaaggagggtaggacggtgggagaaaacagggattaaggacaatgatgaaggggaattttgcctttgttataaaatgttttaaattatttaaaataaagttattgcatttatacattatttgtgcaattaaaatatttcaaaatttcagacttatttatccccactataatcacaagtagtgattactgagtatgggaagagcctagtacctaggggtggtgccattataatcccaaaggacacaatcctgaatgccatcatccctgaaaatattggtatacaggcctttaaaaacaaaaaaggcctgagagtaaaaattagcctgaagtcgaaatctctgaaatcgaaaatcctgaaaatcataatccccaaacactgaaaccccaaatgctgcaatcctgaaagccaagttctggggagggattcgagtgctttccgctgtgctcactgtcgctgcatcctgtagttctggggagggattcgtgtgctttccactgtgctcactgtggatgcttcctgttagttctggggagggattcgtgtgctttccgctgtgctcactgtcgctgcatcgtgttagttctggggagggattcgtgtgctttccactgtgctcactgtggatgcttcctgttagttctggggagggattcgtgtgctttccactgtgctcactgtggatgcatcgtgtagttctggggagggattcgtgtgctttccgctgtgctcactgtggatgcatcgtgtagttctggggagggattcgtgtgctttccgctgtgctcactgtggatgcatcgtgttagttctggggagggattcgtgtgctttccactgtgctcactgtctttgcatcctgttagttcgggggagggattcatgtgctttccactgtgctcactgtggatgcttcctgttagttctggggagggattcgtgtgctttccactgtgctcactgtggatgcatcgtgttagttctggggagggattcgtgtgctttccactgtgctcactgtcgctgcatcgtgttagttctggggagggattcgtgtgccttccactgtgctcactgtggctgcatcctgttagttctggggagggattcgtgtgctttccgctgtgctcagtgtggatgaatcgtgttagttctatcatgttagacaggactcttatcttgtggttgtcttcatctggaaattagctatggtttaagatgtgtacaggtgccagattcacaaggggtagacttgtagacttaattttcggtgtcagcttgactggattaaagagttatctagtaacttggtaaagcattatttcagatatgtctgtaagggtgtttccagaggagattagtacatgactctgaatggagtaggtggagatctgcctaaaatgttggcgggcaccatccaatcagccttgggtccagagggaacaaacacagatggtaaactgctttctctctgagagatgagacagacttttcttctgccttggacgtaagaaacattattccaagtacacgcattatcacaatgctgctttgtgtataagcatggtgcatgtacataaaaacactgaaacttcttccataaatgaagaactgccttttttctgtgtctccatttgtgaaagataaaatttcttgagaccttggctctttgagtgactgtatttgtggcagtgaccagaggtttttgatccatctcatcaaaacatgtctgtcagggtatttttgatgactgcagttacaacgatggatgcatacaatttccaaccatagtaataagcgttcacacatttcactttctgacctatttctttataaatacagtttgtctgttcatagctataatagctgagtgactcccattagtatatctgtgtgttgatgcttgcaaagagaacatgtatggtattgttgcctattttactgtgtaaagtggcctataatgtgttcagtcatgtatttatatgtctctaaagtcttcttttaaaattgtaacaaatgtattttaaatatttttaaaactttattccacaattatatttttgaaattttggtctctcagaattgtgatttggggattttagaatttagggattttaggctggagctagtgaatcacacctataatctcagcactttgggaggccaaggcgggcagatcgcttgagcccaggagttcaagaccagcctgggcaacatggcaaaacccgatctctacaaaaaatacaaaaattagccgggcatgatggctcctacctgcagccccagctactcgggaggctgaggtggaaagattgctggagacccggaggcagaggttgcagcaagccaagatcacgccacggtactccagcctaggtgacagggcaagactctgtctcaaaataaataaataaataaaactagactttagggattttaatctttcaaaatttcaacatttggaattatggcattcaagatagtgtctctcaagattatggtccaaacctccatagaggtactggaaagcacaacgccagatactacagaagttccgtatgactccattctggcgcaaccatatgcccatgtgtcaggcacaatttcctaagaagaaatcaagtgtaatagatggcaaattggtctcggcctaggtcaagcttgtccaacctgtggcccagcatggctttgaatgtggccaaacgcaaacttgcaaactttcttaaaacataagtttttttgtgtgatttttgttcttttagctcatcagctatcattcatgttagtgtattttatgtatggctcaagacaatttgtctccttccagtgtggcccagggaagccaaaagattagacacccctggcccaggtcagtagcaccagaaggatatctagataagatcaaactaaattaataagcagtctgcagctccaaagcattgactttgaccagtacttttgagaatccttaggctaattcctagtaaagcatgttttgcaaataaaaaaaaattatcttccttttttattggtttgccaaaaaaaattaaaaaaaaaaaacaaactgtgaacatacactagaagcaacaaccataataaaacttctggtaataataaggcagctcctcccatatataacataccaaatataacaactataagctctggattcgacatttaaaaaaactaactgaaggtactagagagtggccaaaagcagacagaaactggaagggagttaacacttgaaaataaatgaaaaacactagatgagtttcttgtttataaagctttttaaattgaagccagaaattttctggctgtgccagctggggcaactgcaagttggatagaaatctgcagcttcttaaagaaacaaaaggaaagtgacaggaaaaaaatcccagtgagggccagagtctagtgcataaaatgcctgaatctctgggtgacccctactatccacatgcattgaggagaggcccagcagtccggaaaagtctaaaagaactgaaaagtgatttcagttgctgcccttcacaggggtaacaaagttggagcacacatctgccaatataatagcatgctaaagcaatacacacacacacacacacacacacacacacacacacacttcagaggaatataagagaatccagaaacctataacatattaaaaatgttctgaataaaacccaaaattactagacatatgagggaagaggacagggtgacccattctcaagaaaaaaaaattcaatcaatgaaaaccaacccaaaatggcccaactgcctcaaaaactaggtaagaatgtttatagtcagctttcattactatgcccaagaaaagacaggaaaatatgcttgtaatgaacaaataggaaatatcaacaaagaatcttaaaaatgtgatatgaataaaatgtgaaatgaatgaaaaataatccaataaaaatggaagaggaagagaaagacacaaataaaagaaccagagagacggcagtgataagaactcagtcttacatggtaagaactcagcatgatattgttgcctgtgaagacaaaaggaattttccattttcttatgccactaagtttgtggtactttcttacaacagcaataagaaacagaaatgtgctgaaagagaaggagaagagaagctgccaatctagaatcctctatccagcaaaaaattgtctgcaagaataaaggcaaaataaagacattttcatataaaagaaaactaaaataatttattaccagcagacctgtactaccggaggtgctaaaggaagtccttcaggctgcaggacaatgagactagatggaaggctgaaatttcatgaaagaatgaagggtgctggaaatggtaaatacgtagggaagtataaaagactctttctctgaatttcttcaaaatatatatggctacttaaagaagtaaaatgttgtattgagggagctttaaaatatgcaaatataatatatatgacatctgtaagactgaggagttcatattttacatgaaatgggacaatgttaactttagactgtgaaaatttaattatctgttttataatcctagagaaaccattgaaaaagaacacagagacatatagcaagaaaaaaaaaaaaaaaagctcagccaaaagaactttggcaaaagaaccgaaagataatatacaataaaaatttttttcatggaaaatagttttggaaatgctactatgaaatctcagcaaattctatttcttgccaatgtattcatctgcataagaaatggtaagggatacatctgtagatttaaacacgcacataaacacataagtccactaaaatggtcagattttctactcctcattcaattaaaaaagaaactatataaagaaagcaccaaaagacaaaataccaaacccgtctctacttcagttctctgttccattcacaattctcacccaggaaagagaaattcaaagaaaagacagagctggaacttcatttcctatatatagttagccagcattcttcagtgttgtctacacattcacccacatccaaatgtactgccaacagaccaacacagagaagtgctgagttaggtttcagtgtgtttctaatatatcccattttattcaagacagaataaaattttgtttcaatgtgactcctctgggtttaaaaaaaaatccaaaatcttagacttaactatatagtcaatcaactagtacataaacaaatgacttcagtacactaatgctgatagccaaaatagtaaaaaataagtctaaggcatgtcacttacttgctctttctggctcatttattttaactgctcccactagcattctgtctggttttgttttttttttctagattaattcaattctcttccctttggatgagatagaaaacagaacaaaaaaaatgaaaaaaaatgctttgcttcacaatcagtcagtatttattgaatgtctttattgtcacacagtatttattgaaatactatcatttgccaggcatagaagaagacgagataaataagatggccccttatcgtctaagacttaagtaaaatacataggatatatatacataatagatataaaacaaagctgactgtttcatgaaagcagaaaggagagagacaatcttttcagttggagaatcaggaaaagtttgtccttgcaggatgaggttttcagaggtaagctgggggtggggaaccagaagcagaaataggagaccagggaagtgtaggacaattcagggaaaggtgactggctcagtatggctggagcatacaggctacactggtggaagctgtgagagaaaacatggcatgtctaattatggtggctcttgaagccaagctaaaggtcttgagcctcatttgataggcagtgaggttcacagaagatttttttaaattgtggagtgacatttttcatcatttaacaataaacagcctttggaagtattatgtgccaaaaacatgcaaacaagtaatagtacatcaaggaatcccacaaaatccaacctcaggcagactgcagttgagtagggagctaactatgtaaagagaacaacaagttagaaagccttagtgaggattatgctattgttctgtctaagccaagatggcaagcctgggattgccttaccaaattcaagctcccagactacatatgacacatacatgaaagaataatttaaaatttaaaaaaaagagagaagaggaatcttttttttttctgtaatcagaatacctatcatccaggaaaaggtcataaaacagtgcaaaataacaccacaggactaaaaaaagatttttttttaatgtggcaaaaattaatacaggatttcctttgcaaattatccaggctttttcccattctggcgtagatgccactactctatgtgcccataatgtcctgattcttcctctctgtaatgacagttctcatcccacaggattcaagttgcctgtttatgtatctgacacctctgctattttatcaactctttaagggaaggaattgtgttttatgaatgacattctcatttttaaaaagaaaacaatcgtttgtcaaataaaaacaaaatctgtcttcctttctttagactttcaaaattagctcaaataaaaatatattattgttgacattcagtaaagtacatgttggcagcctcttttaaagtgcctttcataaaacaagcagaagatatacacacagatacacacatacactttttaaaatttgaaataatataagtgctcttactgtaaaatgtcagacaacttttatctgaagcattcaaaaatttctcccctgccccaaacactccttattgggctattgttatcccagtttcactcttagaagacttaaggagaaaaagcattaaatagaatttatgggaggtcattgatttggactaagctcctacactaggccccgagacacgaagccaacatggagttattgagactaaagttccaaactgaaaccaacttgtttaacctgagaaagtaggagagagataatagtctaatccccaaccaggccacttttaggcaccgtgataaggaaggcttcttctgttttaatcttctatgaaaaagtaactttgaaatgaccggccttcttgttccacttctgcttcttcagccgtcttctgcctatctagaccatctcctcctgcgaggatgtgaagtccatccatctttcaaggtcaagaagtttagactttattaggaggcaatggagagtcgaagaagaatagttcaattcactttctgtagaagtgactgaaggaagggtacttccacaactgcaagcacagaagccattaagaggttgattcagcgacccatataatggtggcctcaattaagggactggcagtgtggctgaagaaaaacacctagctaaaagagaacaggaagcagaactaaccagatgtattgactgactgaatgtaaagataagggagagggaaaagtcaacgatgatctataggtttcctctaaacagtcattaaacaattatttactgagcaccaagtatctaccatggttccaggtaccagagatacatcatcagacagaagaatgtctcatttttatggaggttatagtttagcagaagatagacagtaaacaaataagatgtctacaaaaccttctctcatcattctttttttttttttagagtaaagtgaaagcaactttattaagaaagtaaaggaataaatggcttctccataggcagagcagccaatgtgatcattctggccaataggcttcttttgtcttaggtgtgccagagtacaccacgcattttggaactagatggcacagagcagattcacatcatatgtacagcttcactgggaatccttcatcccaatgaagctgataaagtctgaaataggacatacacgttaaaagaatgtctgaatgattgtaaggatttttctggcttctagcaaaaaagtaaaatattgtttgtacttctgaacaatttaaggaattttgaaaagaactctgactctacttttttcccatcacataatgaagattgatgtatttattacttggtggtgtgaattagaaatatgataaatttaaagtctaacttgtttcccatccaaacttcccaactagactgcactgtattttttatttttctctaattgttgtacatgggtaagtaaaactcgtgtaagtttccgcatagttcacactcatgggaaacaaaaactgcgccttgtatatcatcatcccccgactgtctgtcactcacagaattcaaggcacatatgaagtgctcaataaacaagagcttagaggaaatcaatgaggcttagtgcatagccttattgcaaactgtggtctccaatgcaaaaacaaaataaaacaaaaaccccacaactaaaaacaaagtaggggatgttaacaagagaacaaggatatgaaacctatctcatgaaagaataaacatttcacacagaaatcataaatgttggtattaattttaaatgacatttgtcagccatagaaagtgatctctaataactcacgatagagcagtttaatgcccaaataattgaaaaaagaattggagaggtaacctaacggcagataagattaagtaaggaaaatttcaatctgtgtgaagaagagaaggctttaatttttcaaccctttgggacaatttggaacatcagggctctacaccaaaactcgactttatttatcctatatatatcctttatttaggatccctaaatttattttttactttcttcatgaactcgtaagtcagtctcctagggcaggggtccccagggctgcggactggtactggtccatggcctgttaggaactgggtcacacggcaggaggcgagtggcgggtgagcaggcatgaccaccggagctcagagcagtggcagcactggattctcatggagggtgagcaggcatgaccactggagctcagaaaagtggcagcattcgattctcatgagggcgtgaaccctattgtgaactgggcatgtgagggatctaggttgtgtgctccttatgagactctaactaatgcctgatgatctgaggtggaacagtttcatcctaaaaccatccatcccctcctcaccgccccatccatgaaaaactgtcttccacgaaactggttcctggtgccagaaaggttgggaaccactgtcctagggcaaccttgcttgtgtgggtaaagttctttaagaaaacgggagactctaggagaaaaaagaactattattattgtaaaaagaaagattaccaaggactcttcttttaccatacaaaggaggaaatccttactacaccttagtgtccaagttcagtatacctttttgatataaaatacacagaaaagcttaatatttgatttatcttagtgtattatctatctcccccctctagaatgcgaactctataaaggcagaaattttttatctgtgttgttaactgctgtctccccaatatctacaacaatggttaacaacactaggtagtcaacagtagctaagaatggacgaaagaatcaaggcttggataacaaaacagctcgtttatggaatgcatgtatattttcataaggataattagtgtgtgtaatcaaaagcaaagcccttctgaaagaagtccatcaccaatacagataagttaccactttgtttgattatcataaactatcaaacaatgcaacccactgaaaggaaaatgtgagacaaatttaactcctatgaccttagcgttgaggaaggaaagatttacatagcgtccattgattcgctctgggaagagtgtggttaccttcaaaatctaaagtcaaaatctaaatccctaagtcaaaacctaaaacctaagagctgaaagacttctctgtgtttaagcaggcatcctgttttcactctgtggtatctaaatagaagcttcaaaaggagactctgtgcttgtgtttacaaactgtgagactgctcaaatatagaaacggaagactttttgttgttgtttgtttctagtttttctttttttcttttttttgagacagagtctcactctgtcacccatactggagtgcagtggtgtgatctttgctcaccacaacccctgcctcccaagctcaagcaattctcatgcctcagcctcctgagcagctgacactacaggcctgcaccatgtcacctggctaatttgttgcatttttagtagagacaaagtttcgccatgttggccaggctggtctcaaactcctgccctcaagtgacctgcctgccttggcctctgaaagtgctgggattacaggcatgagccactgcacccagcccctagcttctattttttttaattactagtgtaccagctcaggattgaatacatctctcctcctgctagaaaaaatttaaaataacctgagcaatgtagctcatacctgtaatcctggcactttgggatgccaagggagaatgattgcttgaggcctggattaacactccaagacctcatctctacaaaaaaacttttttaaagaaagaatttaaaatagaagtatttatttctttcaagttagcctaaaggccaaatcgagctcctggatatttgaggagttctgaaaccacgtttgccaagatcatgacggtgagaggaatctggcgtgactaactttatcttgcttctagtctcacaggctggctgcccttgctcattcctaggcacaggccaagctaaccatgggagacaggaaggatggtcatagtccctccctaaaactaaacccctctttgctcagggaccagagccgcttttgtaaaactaatgaaaggccataagattagggttatgggaggggcctgcaatttgttaaaatgtaggcgtagtttctataatcccttactgctcaggagtcatgtggccagaggtcacaagatttgtgacttcctcaattgctcctacagataacattactattgtagtacctaagattggtctttcgaaacgtttttcagacgttagcatgctggcaaccaactcacccccctggacctgtgacttatgactcagttggtcccatggcccccgcccagaggcatactcagcatagcaggaccgtttcctaccctcctatgattttatccacaaccaatcagcagcacacattccctagccccttgcccgccaaactgtccataaaaaccccagcttctgagttcttggtgagactggtttgagtaataactccagtctttccacttggctagctctgcattaattaaactctttctttactgcaatatcgtgggcttggcgaaatggttttgtgtggggaaaagaaagagagatcagactgttactgtgtctatgtagagagaagtagacataagagactccattttgttctgtactaagaaaaattcttctgccttgggatgctgttaatctgtgaccttacccccaaccctgtgctccctgaaacatgtgctgtgtcaactcagggttaaatggattaagggcggtgcaagatgtgctttgttaaacagatgcttgaaggcagcatgctccttaagagtcatcaccactccctaatctcaagtacccaggggcacaaacactgcggaaggctgcagggacctctgcctacgaaagccaggtattgtccaaggtttctccccatgtgacagtctgaaatatggcctcctgggaagggaaagacctgaccgtcccccagcccgacacccgtaaagggtctgtgctgaggaggattagtaaaagaggaaggaatgcctctttgcagttgagataagaggaaggcatctgtctcctgctcgtccctgggcaatggaatgtctccgtgtaaaacccgattgtatattccatctactgagacaggggaaaaccgccttagggctggaggtgggacatgcgggcagcaatactgctctttaaggcattgagatgtttatgtatatgcacatcaaaagcacagcacttttttctctaacttgtttatgatgcagagacatttgttcacatgttttcctgcagaccctctccccactattaccctattgtcctgccacatcccgctctcccagaaatgcccgataatgatcgataaatactgagggaactcagaggctggtgccggcgcgggtcccctgcgcccacttttccttctctatactttgtctctgtgtatctttcttttctcaagtctctcgttccacccaacaagaaacgcccacaagtgtggaggggcaggccaccccttcagttttgtctgtgcagcagacaggaagagccagttgggtgactacagttcccttcacacagaataaaagttcctaaacaataacacagctaatctcacctacaattcaggtaagtcaaaactatgagccctttcccttactgagtcccaagtaagggggattctggtccaaacaaacaaaaaacccacacaatacacacataaaggtcacaatttgtatttgctcaagaatcatataactcattataaaccgaaaccaaacgaaatgaaagactttattagtaaaaattatgaaaaatttgaaaatatgtcaaaaggttacctttatattcttttaaatattggaccacagtctaaacaggcccacccaaggatttttttttaatactgtagtattgtttggcttactacttattatctatcagcataaggactgctaagtaacatattaacttgcagatttttgtccaaaaggatgtaaatgatttttgtgtgatagaaagatagccccaaagacaacagttttattgccctgtaagacattaaccaactgacaattcctttttttttttttttttcttttttcttttctggagacaagagctcactctgtcacccaggctgaggctacagtgcagtggcatgatcacagcccactgcagtctcaacattctgggctcaaacgatccttccacctcagcctcccaagtagctgggactacaggcatgcaccatcatgcccagctattttttgtattttttgtagagatggagttttgacatgttgcccaggctggtcttcaactcctgggttcaagtgatcctcttgtctcagcctctcaaactgctagggttacaggccactgcacccagcccaatttactgatcttacaatcttattctagcattctatcagtgcctatatataatttatctgtggaattttctgggaatcagcatcaccattatgttgattccctcattcatcaggcaaataaatttatgacacgcacttactatgtatttacgagggtcattgttttacctctgaaaaatatattttgatatcttaaagttttggtatattttcttcttagatgcctacagaatataggaaaggtaagctgttactggtctatcaatggcaacaaaagaatgtaaattgattgcattattcattcttcagcaggctgattactgatactatagtcataccattgaattatttagtaacaaaaaatctagtaaataattacaaattatcagtgactaccatattctttagagcacattattttacccctaaagatgcgcattaacattttgtgattagagtacctagaagactacagaaaagagcagaaatgatcactaaatgctgcatgtacctcctgtgttttactcctaatgcagctttaaagctgtacatcctaaagaatattgcattttctcttttaacaacataaattttatctccagcaaagaaagtgttacactatctatagtaaattttaaacacttcaatatagaagtatttccagtgtgatttatgtgtatctgggttagtttccactcacaccctaatggtattagttaacatctgaagtaccctaatgaggaattaatccagaggtggatgtttatcatctgacacatggtgaccatctgccacaatgccagaggtagctactgatggggtccaagacatcctaccccaaaatatggtactttggcatattagatattttaagctgaaggatttgagaaaacagaccttccccctccccttctcccctgaaaaaggttataaaatctttcctacgttttatgaccttccccgaagcaggtcaaaggaccctaatgtgtgaggtgccctccctatacccagaagaaaggggcatccttatctccaaacatgcagtgacatagagacctgaacaaataggtcttactaagcatcctccagtttataacattcagctcatcccccgctttgtcctatcacatttctctaagactctccactcttcatcaaacctactatgaaacaagctcacgtttaactgcttcttcgggtcttcatttccttatgaagtctcccatgtcacataaaacttgaataaatttctaataaaataaattttattagagggggtcccagctacccaaaataagtagcaggaaagatacttttcctcccctttgctacaaaacattttcaaatatctttgtttctgatcaaccttaaaggatttgataatttgcattatagataaaaatatttttccttggtgaaacaaggggtgtttaagatatgtggatggctaaaaacagtagaaaaagaataattagtttatttccttttgcctttgcttgaacaatgtacaagaatctagcatgccgaatgactagaattaccataggttgcaatttgcctgttacagtcccagtttacatttcttatcccaacataattattaagaatgccctctttggttctcaaagcattctgctttggaccacaaattatatggacaccccaccacagcatacctttcttaaaggccccctaggcttaatactaggatggaccctgtatggatttttgtcagcgaactgctactaggttagctgaattccgaagctaacgcactgtttcacctgcttcaagtgaatctttctgtgataaatttatagaacaactggtgtgacagtttttgcgcctgcctaataaatgtttgtatctgtgcatgagtcagtctgagacttgcttttattacaacacactgcctgggactgtgcttgcaggtgagaagaccttcagttttcatttgctcctatctactagaggctacggatatattttctttttttttttttctacacttcacttattagatttattactaagtacttgatgctttttatttttatttttagatttcagtaaaatagtttaatcaagtcactaaacaagcaaatgacaacaacaacaaaaaagcctcagagagagagaagggaaatcaatatctagttgctaccatatgacacctaaaatgccaaattttctttttttttaatttttttaatttttatttttattttaagttctgggatacatgtgcgggacctgcaggtttgttatgtaggtaaatgtgtgccatggtggtttgctgtacctatcaatccatcacctaggtattaagcccaacacacattagcaatttttcctgatgctctccctcccctcgcccttccgacaggcccagtgtgtgttgttcccctccctgtgtccatgtgttttcaccgttcagctcccacttatgagtgagaacatgcggtgtttggttttctgtctctgcgttagtttgctgaggataatggcttccagctccatccatgtccatgcaaagggcatgatctcattcatttttatggctgcatagtattccatggtgtgtatgtgccaccaaagctcctctatctggcagttccttgcagatgaaagctccccccatgattcagaataagtagagcttttggccagaagagttttcaaattcttgcccttatagctacaaacccatgagcctatttctagatccttcctgttattcttattatagagggaataagcatctcttgctactttttatcactagaccaacatctttcttccctactagacataagttccatgaagccaagaccgttgacttccttaatcatctctagaaccctgggttctagcacatttggtactcatcagttagtcaatatctgctgaatgagtaaattttaaaaagtgtccttgatttctcctccagaccattagttgttcttttcctgttcaaatagtcggaaagcaaaggcaaggaaaaaaaatctcagaggctcacacaaaaaaagctacaaggaaaaacaagttcagttagttgttttccgtggtatctatgaaacttttttctaaacaaataatgtgttctgtccaaaacactttagcctaccaacatagcaactctacgtgcaataacggcatgactgcactgattctgtgtcttgattttaactttcaacaagtaaaacaaacacaatttgcaaagcagaattccaacactgctgtcattacggctttagataaagcaccactgacaaggccccctctagattctacatgaagacttacgcggactgaaacccgtcctcagtactccaactgttaaccaaaccgcctcccaactctaaccaactacatcatagcaagcaaatctttatatgtaaacatagaaaattattatttttatctagttgcacaatgactttctaactaagcttttattgaaaaaacatacatctcactaataaggaaaaaaaagagcaatcacttgtttagaataaatgagatgctcttcgtcctctgtgagcccctttgactcatgaattggtttaacttctgaaacctccagtgtagactgtccctatctacagcgagcgccatgcacttatgagcaggaaacacccatgtgacaaagctcagaactgtcacggaaaggtaacccaggtaaaagcgcatcaaaacaaggacacacacacactctctctctctttctctctctctctccctctctccttctttctctttctttctctctctctctattcaggagttctcaatttcccatttctcccggcttaaaagttaagagtaatcacgcctgtaatcccagcactttgggaggctgaggcgggcggatcatgaggtcaggagatcgagaccatcctggctaacacggtgaaaccccgtctctactaaaaatacaaaaaaattagccgggcgtggtgacaggcgcctgtagtcccagctactcgggaggctgaggcaggagaatggcgtgaacccaggaggcggagcttgcagtgagccgagatcatgccactgcactccagcctgggcgacagggcgagactccgtctcaaagaaaaaaaaaagttaagagtaatgagggaaattccatgaagtagtccaactaaaattttattttatcctagaggtaagtctgaggacattgattagtgcttatttttgttttcagtacaatatccccaaaagtttgaaaaattagctttgtcacaatacacttcctatattacatccccttctaataatttcagacagcttataatttgtataggaagatggcaaatgtttttatctttatgaaatttatgtgtacatacacacacatatatattttatatccagaaaagttttagctacatttttagtttcagaggctttgaattcattgattattgtgtaggtaattacttgaccttatatttatttgagatgatcttttattttttgagacagggtactgcactgtcactcaggctggagtgcagtggcgtaaacacggctcactgtggcctcctgggttcaagagatcctcctacctcaacctcccaagtacctgggaccacaggcatgcaccaccatgcccagctaatttttgtacttttttgtagagatggggtctcaccatgttgcccaggctggtctcaaactcctgggctcaagtaatcctcccgcctcagcctcccaaagcgctgggattacatgtgtgagccactaagcccagccactcgaccctacttttagaaaattcaatacataaagatgacatttccctggaacattctttctcctataaccaaaacattaggcatgagttacattttccatgtccatgagtagcacttcatgttattatatttcctaagaactattttaattataaattttagatgcagtgaattattttgggaaaggtgcatatccaacccatccctatttcgagccagaatagcttagattcctgaaatcacttcagttgctcctttaagaccgtgagaaaggaacatatgaatcttcacaaaccttcacagaagcttgttgaagattttggtttctaaaaatatttctatttcacttgatccagattttcatgttatatttcttttgcacaccatgaaaacaagttttcaactactcaaccaaaagtctcgggtagaaaactgcccctttatctcatgatggtatgaacaggagatgagtagacaaaacttttagacctttaccggctgttcctaccccaaatgccagccactcacatgttttctcgccctccaaattgctcagttttcatgatgctgcatttaaaacctatgtctgaaattggtagtttgctttttttttttttttctgggggaggggtgtttttacaagggagatttgggggaaatgtgggtatggagaaattttctttccattttccactggctggcactagaagaatccagtcagtttttctctgttctttttctccctctgtcctcttggtaccaaagcagtcaccatcacaaattccctttctttctattagtggatatggaattatctagcattattaagaataaggtgaaactgtctcagacccaggcttaaattgcaaaatgacaaaatatattaaaatactagagtacaaaagaaaagatacagaaaaattctacaaaggtatatatgaatggccaaactgtccaacatacataatccttgcataagcacccagtatgtcctaacagagaaagaaaccagttccagaaaaattaagtcaaaataatcacatataagagcttctctcttttagcccttcagtgacagctgaacgttggtcattaaatgggcatggaagaaacagagagaacaccatcttctgtttgaacaaaatcctgatctccaccaagaactgaaattgggtcttctccacttggaagactcctctctctatagagaaagagagagagctgtttttctttctctctctcttttttttttttttagatggagtctagctctatcacccaggatggaatgcagtggctggatctctgtctgctgcaacccccatctcccaggttcaagtggttctcctgcctcagcctcctgagtagctgggatcatgggcgtgccccaccacatctggctaatttttgtatttttagtagagatggggttttgctatgttggtcaggctggtctcgaactcctgacctcaggatacacccgccctccgcctcccaaagcgctgggattacaggcatgagctaccacacccggctctttctcttttcttttgcctcttaactccgcttctaaactcctcttgtgtgttcatgtcctaaattttgctgacgcgaaatgacgaagcccaggtacgtaccccagacaacgtagccacttcatactgggaacctcgtcggggaaaccaaggtacagcagtcaccgaaatggtgagcagaggaacggactccaactctgccctttcatttcaaggctctcggcctaaatgttagaaccatatcaaatcagtaacaggcatccgtcagccagttagaaacgcggttagcacggctgctgttcaaagactgggatgccaggcgtactggggaaaacatggagaatctcccagcacccatgggttgctgggcatgttggccacgtgtgaacaagcttcctttcatgaaggacttagccatcgcttgaagctggaagaggttctggagcaactgaggatttctggctggggctaccgcccagtattacccaaaccctcctggactgaccccagcctccaccgctggatgggttgtgggcaacaggattccaactttcctatgtagtttcctcctttcctgtctgcacccaccatacctcctgtcttttccactcggaagacccctctctatagagagagagctggttttctttattcttctgcctattaaacctcagcacaaaaaaaaaaaaaaaagaactgaagtcggttctggactcatccagggaaaatgtgctttaaatttggctgtggtgttctccagtggtcaaggagaatatgctattgatttgtgctctggcattaccactgcacactgacaggcagttcttttaaacacatacttgcgtggtttagacaatgtctgtgtatgactgaagcttcacttgaaatcctagtagttcttggaaatatgtgagctcaatgagctaaatatagtgccgacaggtatgagtgattagcatggtgctaactctgcatcaggaatatcaactttgtgtttccaatgctactttcaactttaaactcaaaggttttttatataaacgtttaataatacctatagcctttctattgggcatgaattcaaaacagacaagaaaataggtgtcttaaccacattatcactgctgatcaccaacaaaactgttaataatcatagacacagaaatctggatatgtcctctagtcatttaacacaatttttttttaaaaagtatatgtagcttttactaataaatattatataagattctgttatccattcaaatcttactttaagaaaaaagtcaatttagactaaaggccatgtatgtggtattatacttcacttttgataaaatctgattaattataaggcataatcttactttttcaggctgagggtcattttaagtgcttattttttccaaagaagtgaggaaaaaatgctgaaatgatttcaaaattcttacatgcacagtgcaaatttaaattgctgttcgaaattacccaagacccatcagaaaagaggaaaccacaggagaactagaaataaacctatttccattcttggaaaaccatcctgtacattaaaaaatgtcacgcttctcataaaaactggcaaataggccagtggaatagaacagagaatccaaaaacaaatctgcacatttacggtcaacccatttttgacaaaggcaccaagaacatacattggggtaaggacaccctcatcaataaacggtgctgagaaaactggatatccatatatagaagaatgcaagtagaccccacctctcaccacatacaaaaatccaatcaaaatggatcaaggacaaatgtacaacccaaagctatgaagctactagaagaaaacattggagaaatgcttcagggtattggcccggcaaagatgtcttttgagaagaccacaaaagcacaggtaacaaaaccaaaaatagacaaatgagattatatcaagctaaaaagcttttgcatagcaaacaaaacaatcaacagagtaaagagacagaatgggagaagatatttgcaaactctccatctgacaagtgattaataatgagactatataaggaactcaactcaatagcaaaaaaaccaccaaaagcaggaaaaaaaaaacaaaaaatgggcaaattaactgaataaactgaatagacatttttcagaagacaaatgcccaacacatatatgaaaaaattctcaacatcattaatcattatgaaatgcaaatcaaaaccataatgagatatcatctcaccccagttaaaatggccattttaaaaaagacgaaaaagaacagatgcttgcaaggatgtagagaagggggaactctcatatcctgttggtgagaatgtaaattagttgagctgttatgcaaaagaaaacattatgaatgttcagtgaaaaactaaaactagaactaccacgtgacccagcaatctcacaggtgggtatgtatccaaaagaaaggaactcagtgcctcaaagagatacctgcactctcatgtttatcacagcactattcacaacagtcaagatacgtaaccaacctgtgcccatcaacagataaatgcataaagaaaatataatgcatatatgtgtggtggaatattactcagccataaaaaagaataaagtcctgtcatttgcagcaacatggataagcctggaggacattatgttaagtgaaataatccaggcacagaaaggcaaatatgttatgttctcactcacatgtgggagctaaaacaatttgaggtagagagtagaggggtggttatcagcggctgcgaacagtagtgggggatgaagagagcttacttaatgggtacaaaaatataattattacgtacaattattatgtatcaataaaactaataaattgaaaatgatttaagttcctaaaacttgataacaaaacctcagagtaataatttttcagtttatttttttttaattccaatagaaattctattagcagaagataaaattttaaaatggtaacaaagggttctgtgcatatttggatacatttaatatataaaaacaatcccattcattggcagtccccttcttacccgccaaatacttttttagaaacagaaccacacagcccatacaaattcctggtttactagaagtcggtgtagcgtgtgtttcactatcctgcatatatcccctatgcggacaggggcagagctgtgtctaactaccaaaaacccacttggccataagggaggtggggccgaacatgtcctaggaacacagctgtattctcactacaaggactactccagccgctgtcatgggggcagctgcctgcgggagaccaccaagatgatgcagtgtttgtgatattcatgttatttctaatcaaaggaaaaaacactaccatgagggctggtgataatgttacactgaaactaacaaagacagggaaaggtacctcatgtgccaggtcctgtgccggggactttccatacactgcgtcctttaatccacacaccaactccgtgtgggaaacacagcagtctacccagcagtatactaccctaggagggctctgataggttaagtaactttcttaaacttagaagagaggactgaaccataagcccagtccttgcacttccgcctgctgtgaaagactacaggatttaagttttgtatcattatgacttagtgtatctggatacttggggctctctcagactgatcttccagagagcatgtcccccgcctcgccaccaacagtccataactttccagacttttaaagccctctgggttgtaacaaggtcaaagaattgccgttcaatgcccaggcagatacacaaaggtccagagccactgctttttctatagcaaaacgcacaggatcactcctggctgtccctcaggattttaaagtgacatatcacatgagccatacttcatttcttcacggctaatgtccctccagaaataccagaaatcagtatcataacaaacctaacacacatcacagttcccacttttcatatctaacctgcatctaaatctgctgagcgtatctcggagcctctctccagtttgcctccttgccattccctccctccatggcggactttcctcttctgtggccctgagtgtttacggcaagccccgcattggtatctctattagaccctctgcccctcccagtgacgtcttgatcctcttctgctcgggcaccatcttcttcaaacagccttctctggtcccctcagctgaactgcaggctcctcttctgggcttccaaagccccgtgcacatatcatcgcatcaatgatgcccagcactggaatgtgtttgtctgtctctccccacaccatgggcttgcgggtggctagcacaaatacaacttcatacttctttccttcacaggaagcaaaacaattcgaaacaggagttaagactgtccaggagaaaggggaaggagcccatggccatttcgtatctcttcatagctactcaatcattaatttaacaaataacttatcgaacttatactgtatgccagataatgtgctaggcactccaagggcagaagtgagtgcacacaggggcaaacaacacagcagaggagtcagcacgcaaatgtaatatgcaacgataaggtgcagacaagcttctttgggagcacagattaggaagacaaatcatgtctaaaggattcaaagaagactgcacaaaacctggacatctgagcttgggactgatgcatctgtgggagttaaccagtaaaagacacaaggaaagggcaggctgacatcaaaaacaccagtcaaatcaatcaagccataaccaggccttaaacccagctgctttctttcaaaggagaaaagcagcccgagcaacacagtgagactctgtctgtacaaaaactcaaaactaagcctagcatggcggcacgtgccacagtcccagctactcaggaagccaaggcaggagcatcgcctgagctcaggagcttgaggctgcagggatccgtgattatgtcattacaccccagcctaagcaacaggcaagaccctgtgtcaaaaaaatacaagaacagtaaataaaggagaaatggcctgaacatcaacttcaactcctatttttcatagagcagggccattactaaaactcccttgaaatatccatacaaagacaccttctatcaagccatgattatagtattttcttcaatatttattggaaattacataaaatatttcccccatgaacagcacacgtgcaattctgtgagaacagagtaaataaaaccgatatatatcaaacagtaccttttctgcagttgagaggtaagcaaaagcatcctctgtttaataaacaagaaaaaaatgttaaggaagaatgtagaataggttgccaccaaatatgcaaatgcattcacgcttaatacctattcttagctgaagtgtctagaggttgctttgtgtcttgcgcatcaatctcagagcaagcagaatagatgatctgaaatattaatcctaaacgggtcttgccagtgggcagctgtgggctcgcagaacctctgtgtagacagtctcattacctacttgttcaggcctctttgctggcaaaaagtatagctgaataaacagaaagacaagatctgcaatgcctcagcgctcagaaaattatgacgatgggaagaatgaagctctgaggtcaaaatcttttaaacagcaataatctttgcactacatcagacacctggcaatctcagtccattgtacttatgggaatgctttttagatgttctgattaatacgggtacttgggagcctaaacacaaagacctaactagaatacattgcaattctgagcctcaggcaatgtatatgaaaaagataccagaactaacttttgttgaataaaaggattcacggttcttgcaaatggttatgattgtaacaaatgtttatcattgtaacaaatggttatcattgtaactctaattccagttacgtgacaacaagtacagtttatgggaaaagacatgtgcaacaaccaccaaatgatctgtccatcttaccaaagacaatgaaatgatgagtccctgctagtttctagatattatttatccaagttgttgatttgtaggtgctcattccattttctcctacataatccagtaatctataatccagtaagaaactcacaacatagacatgcaatttacagtttctgcatagggtcattaaaaattctttcattacaaagtatttcttggattcttaaatatttggaaaatgcacaaaacacgtgaaaaatatagttgttcagacaaagaaacgtcattctgatctcatgttttctccccaggaacagacttcacagcaatccattccctttacatttattgtttccttaacttgcaccaagcctgaggaggtcagtgcttggcacacattaagaaaacaataaatagggagggggttacaaactatgctgattccctgttctatgcctcactctgggtgaattcaaccgtctgaagggatagcaaagtcagaagtatgtggcaagcagcaggatgccgagatggttccagctcagacaaggttccaggagagagagcctacccatctttcccaggccaaaatgttttccatgtaataaaggtcaccagtggttgccaatatgcgtatacgaactatattggcttggtcagagttagctggaaaagcaaaagctctgtagtactccagagttctcagatagacctgtccaaaacctctcattcctttgttccaacctttaatttccaacccccacaatcccaccccagtttccaaccagtactttcaccgagagggctgtaccactgcctgagaagtcacacaataccttctgcttcgtgaccaactcagacttggatatctacctgctacctatcatatcaatatgatgtagaggagtgtccggggccctagacctaaatcactttgtgtggcacctgcatcagccttccttagtgacaatcttaaatctagttggttttctttgagaatttatttccttcccaagtatatttctgtgattaaaattatgtggtgtcagaagtttagtttcaattatattttacagacacccgtctacattaaatttaccttcttgcttttccaccatccttagttttgtcgtagtgtttttgttgcaaccctgttcttccttcctgtgtctaattatttaaaaattaccactaaactgatttttatattttatttccatcaagataaacaagatacaaatagatgccctcaaaaaagttaatgatcaattgggtaaaactatatctatacccgcacccaaaaagacaacataattcaatgcacacatgcaaatcaagaacaagaaagatgatggaattagctccaaaactactaaccttcacattaatctgcctcttgcatgtcaatagtttatttcaaatattcggtccctgtcaatctaagaaagtcctaaatccaaagccctgcgggaatgacatgagtttcctggtgtccagcacacgttcgaaatcctgctgtgtgaagagggttcagagaggccaaaaggcaccattcatggactttaggagaaaatattttgtattttgtgcatttagaaaaaggctacaatttgaatgtttaaatatttaaagccaataaacaaggagctattatttaatttttaaaaaatcttttttcaaatttccctggaatattttatttcatttacaaaataaatgtatgaagatgacaaaatcttagaacttttttgaggctgagtgacacactttatctatactgttctaaattttacattaacaaaattatgttcatcacttagaatgtgacattgtatttagaaagtcagcttcccttgtcctattaaaatggtatttagattgtaagtattttattatactcaacttttcaaaaacataattattatataaagaaagatatgtgtagttatatgtacatgtatatacactcacacacacacatttgtaatcctttcaggcttacacataaacacatgttaaaatattgaaaagcagctccaaaaataactaaaatgtcatttgccaaactacttctaggctatctctgggaatagtagaatttttggtcataaaaggaacaaaacatttcctattttgcttttctcccacccttttccagccaacctcttctaaccagtctccatctttaaataatgctagagacctacaatagttttcaactatcagatttaatctctttggttgtatcagactgataagttgaaaataaatggtaatagccagtttgtgtcgggcctatcgggcaagttgtttcttcagaataatattcaatttgatacgtattttgaaacaaacatttactttgtttcatggccggctgtgaataaacagttctctaagttattagtgaagggacagcaaaatttgaccattctatctacccatctgcttctctgtggcaacaaactgatttccatgggacgcttgaataaagcaaggctgtctgtccaaaagaagtagaactatgtcctcaataggcaatggaacaatgactgacactgagtcctagcactgtcaccaatatcccgaacaatcaagcttcaaacccaaaaaggtgcaaataaaatttaagactagtttgggtttggtcccaatggggctaagaaaaactagtgattgttgaacactggattcactgacaactggagagaaaaaattaaaattccaacattatgatgtcaataataatttcatctgcagcaacattcaggaagctgatgagatgatcctaacgggtgatttaaagtgaaagggaaaaaaaacacccttggcataatttaataagatcttcagactgaagcatattcaagggtttcatgaaagaccttctcatggccttttaatagctctttccaattccaattaactggttaaatgccaattctcattacctcatcagaaatccaaagccagtcttttctgattaaatcattaaataactgttaacagtacaatgactagtaagtatttatggacagcccagcactgatatgcagctttcagttctccgtgccaaaggaaaaactggagtgggcgatttaaaatcataataaattctattcatcttcggaatgtgctaggatatatttatctaatatattcactcttcttaattgttttactggcactaatacatagattgggaagacaggcatgatggctcatgctggtagtcccagctactttggaggctgaggtaagaggatcccttgagcccaggagttcaaggccgtggtgagctatggttgcgccattgcactctagcctggtgacagagcaagacttcaacgcattaaaacaaaaaaaagtttattttagattagtataagcttttcatactctctaaatagactgcagaaatgatgattaaaagggagttcatttttgtggaaaagccaggtaggtagtgaagaaatgggaaaacatgtcaactgtgacctgccgctgcctggcagcatgacgagtcagatggccccactcaggagtcactccaaggcctgtggacgtctccactgggcaattaccacaccaacaggcaatgcctatgtcaactcataccaaagctcactttttccacagatctgcctgcaacccttgctttccctcctccctgactgcttgctgacgctcaggactggacaaacatggctcaagagaccagggttctggttccaagtccaagcttgtcaccatcctcccaagacagaagatattcaccctcagagttggaaaaggtcggctctgccacgtcctctttccttttgcacttttattttttatattcctgagcatcctgggacagagctcctctgagaaaatgaatgcgactctccagaggacgatccacagcaaacccaaagcctcctttgcttacaagttatagaaagatcccacgaacactctattctctatgcaacttcttgtccatgcagtcttaccatgaggaggatattatcatggagaaaaacaggctttgacttaaaaaacaaaataaaataaagcataatcaactaaaactaccatttaacttatgctgtaggtcactgcagcaaagaaatgatcaagtttcagtatcttccagaaactagataaatcgtcatagcttgtttaaatgaatacatcactagtaatatgtatttttaggggttttttgtttttttttttttttttttttttttttttacagagtaagacgcttataatatgtgaagttctgtccacagttacctgagatgttagggttagttgagcttaaaatagatacttccaattagaagcagccaaatataattttttatgtgagaaaataactgcaatgctagtatgaccctttattttcctagggctaaagtcagaaaacagaaacaaatataaaagtatcacattcatgtcaatggcttagtgaagacaggaccttattatcctttaaatgctgcttaaaatgctcccagactcgcccgtttatctgctcctcttccagcagagtgtctggcacaaaatggctgttccttcaatctctgccaatccccatccacatctttcaactggcaggaatttccctaattaaatgctacctgcagtatttttatcacactctcaatcatcactgtacttaaaagcttagctcataactgtcttttaatactttaaaaaatatggcttatgtaaattttataaaaatcatttaattgtacattgaaaatggtattttatggcatgtaaattatgttcatatgcggttaggttcttgttctcaagttatttcattttgcttctttttctttaaaatttattcaacacaacagttcaaggaatgaaaagattccctctttttctttaacatcttttcactcttcccggtaggcaagcgtaagataaacattaagtgacacataaattgcctctttctgtcttttgagctcaatgccctgaaagcagcccaatctcctaccttttatgtttgttggtaaatttaaactgaagaattaaacaggatgcaggtgtttgaaattctctttgttcggcctacgtaaatacctccattatccattttaacaatctattcctaaatgctgatgattcccaaagttctatccggctttaatttctccacagacctttgcatctgagtacataactgcctgctaaagatctccaggcacctcatatggtttctggagctgaactcatcatccttcttcccagcacgcacaggctcttagcaatgcttccactatgtacgtagctcaagcttgaacctgtgtcacctcgaactccttgcctctctcctactttctgacttgaatccacctcgatgtcctaccaattttactttctatttattaactctttagtctgtccccaatattgctgctctagttcagattccaaatatttctcacctgaaccactgcaccgtctctcaggtgtctcccttcttctctacatctcagatccccttctccataatggccagcacaatcccactgaaactccatttggttgcttacttctccattaaagggtaaaccctttaatcgctgttcctctctttctcactcaaccacaaattctcacatgccatatagaacccagcctctgagaatctggccccagccatctcttcctctaaaccctacagtcccttcttggaatgtctctcttgttttcaccggctagcacgttctcatctcctaacagtattctaggccaggcatggtggctcacacctgtaatcccagtgctttgggaggctgaggcaggaggattgcttgaggccatgagttggagactggcctggccaacaaagtgagaccttggctctcaaaaaaaaaaaaaataataataataataatcctacctactccggaggctgaggtggtattaaacccaagtgtttaaagcagcagtgagctatgatcatacaagtgcaccccagcctgggtaacagaaggggaccctgtctctatcaaaacaaaaaacaaaaactattctccttcactgacattcatggccccacattctcagcaagatttgctaattttgctacggctcctgtgagcctatccactccaaccacactgctgtatttaagtgcctgtcctccactttaaaacgtgagctacctgagggcaggatttatgtcttgtatttctatccacaactcataatacaatgattcttacaaggtaagctgtcaataaatattgaagaatgaacaaatgaatatagggagttcaaacatgagaactaaaggtctatatcagaaaactgtcagtcaagattctagctgttataatacagaaggccccatcacattccccaagacaaatttatattttcccactgtccttaattttatttcttatactctcattcctgaaataatgttgattattttgagaacagaatattaaggctatcgagagtgatgcttctctctcctcttggatgcaaaaattatctgtatcttcatccacaggaaaacatgtccctccctgtgattcagtttgtccatgtaaaaagaaaaaaaaaaaagctcgtgctcctcacctggccccccatctcttcccaaaccccactcattcactttcacctctgagacagccctcagatttattccctcctctaaattcccagagccactgctatagttgaggtcgttatcatctcttatttagactgttttgacaacctcttaactaatctctccccttctagtctctccctttcataacccactctttatgcgcctgggctctaaccaaaactgatcatgccttaaaatcttctcatgtgaataagaaaaagctcaaaattattagtgtgaaaatcaaagccttatactgtcttgcttcattctacctttctaacctcacctccctgggtgcattctagaacccacccatctgctgatcacttctcagcaggtgctgtgtgccatctctcctcatttgtgctcatgcttttttcctttgactttatccctctgtcaccctgaaaactccctactcatccttgaagaaaaccttgttcagatgggccattcttctataaaacctttcaacctgcccaattacaaatcatgactcttttcagggtttctgtagcatttatcttatacgcctggtatggaacacaaactattagttctagctccactctaaaatgggagctcctttgaaagaaaagtctatgaattacacatctttgaatattcactggctgagataaggcaagaacaagtcttaccactgaattttcaggagcacctaacaaagctccaagatggagataaatttgtggaataaaagaatcacccacttgtaagagcgaatatgcagaactgggtaaatgagttaacataaaatactttgaaaacataaatatgtccaaaatgatttaaacatttactgtgaaacatccctggtatacaaagactagaacggtgctactcagagcatgctgttcaccagagactgttgtggatccactgtgaaataagaaacaaaataaaaagaataagtatttagaaatttctacagcaatgtgacacggctgatccatcaaaatgcaggctgagtgggctcgtctcctgggagaaggtactggctggttcgggtcttgtcgaacttgtgtataaaagtgacacatggggcaagagctgcaggctggtcatgttgcaataggacgatattcgtctgggacagactggaaatggggggaaaaataacacaagcctttcgcgagacagtttaaaaagcaaagggagtaaaataagaaactccagtgtaccagaaccaatttcctcatgtttaccttccatattcgcttgagacctttcctccccatgataaaaaaaaaattatagatacagttgaaaccacctctatgtccttccccaacccttgcgttccccctcctgctcctatatcattttttaaataggctactgtcaaaggaaaagcagagctggagagcagagcaatgaaaatattttttatcaggactacagcaacagggggaaagagatctcagtcaagaccccaggctgaatccaaacacagcatcggcaagtgggaatttatagccaaagaggagggtggcagtcggtgaatgaaaaattattaagaggcaaaatcacaggtaagaggacattctggccacaccatcctaacaggattcttgccaaagacaggccaagatgatgacacatcacccgatgggggatgaggaagccgatcagacactgagactgatcagatatgaaggactggggttctggctaaattgacttagcagggtccttgctaaaatgcacagatgggccctggtggggacagagttcaggaacctgactaaagtttagaaaagcaaagaatctttgtcagcaccaaatcccgtttaggaggatgaaattttcctgttgaggattagggtcatgttttatttcaccaaaaaaaaagcactaaaaatgaacaatgatcaatgttattgtacagactctagcctgctaaatattatgtgaaaaggtgctgtgcccccttgtctgtgacccttcagccacaactcatacaactcaactcctgaactccaagtgaaaggccctgtgctgccccaacctgcagagggagaaacaccttactgaaatgtctacaatttggaaagaaagactaaagagcatgttgtatggctgtagaaagaataacacagacaacggatttattgctaataaaacagactaagaacaatgggctgatgagacttaactaaaaagatgtttattccaatgttagaggttacctcagagaagacacacagagaaaagaaatgcccgaaatgccaggtggaaagtaatgggctttccacggttaatcaaatgggcactgccatgccaacgtgcctcctgaaattcaaaccctctatttttgcatggctgccaactcatttccaaaacatccactgctaatcaaacttgtttggctgcctccttatcgaaactttacaaaactttaatttcagcctcatgagccctgcagctgtaaattaattgaatgaaattgacaaacattatgcagtgagataaagcactttcaaagtcttttccctattcagttgacttagctgcccagcatgccagttttgcttgacatgagttcagaatccctggaaaccttcctaatcctactctctaggccttgtgcctattcatggaaccatgttaacccatatccggaaaattaataaacctcggatgggtttaagcactcaaaatactcctgatacttcttgccattcattacattgtagacatcctttgcaacaggagaatcctcctcaaaagaccacgacggcagcagataaaatccctgaggttataagcatacaacaaaatgtctcatttaagattactgcagtctgaagccaggaattaaatttgctgaaggtgcagtcacttatgccttagttaaataaagatagtcccaaaactgatttctgaacttacccatttctcaaagggagtgcaaaattatcatgatttttaaacagcaaggcgagtaaactgatcgcctctgtatctgccaactgaacaaatgagtcagctaatcagtggttacatacatcacactgacagagaggagagaagaccattaactttctgaaatgagaagtcctaatataccgaggtgccacaagtcacttaggatttccgtggttatgaaagaagaattgaaacgtctcttccctctggtgggttttcacagcacaactgccacagcttccaactgaggtctagtctctgaccttccctcttcatcaatgttatcagcatctggaagccctctggcctatgtggagccatggggacaatggaggcagtttcaaagcttctgtcttatgacagaaaacctgggtgtaaaacaacctctgatatgaactactaagggacttgtatagattccttaaactctccgaaacactgttctcaacagcaaagtgaggagaaaaacagctctcaagtagggttggtgtgaacgtgaaaaaagagaaagtaatacaagagttgggcatataataggctcttaaaaagaattttgaaggccgggcacggtggctcacgcctgtaatcccagcactttgggaggctgaggcgggcggatcacaaggtcaggagatcgagaccacggtgaaaccccgtctctactaaaaatacaaaaaattagccaggcgtggtggcaggcgcctgtagtcccagctactcgggaggttgaggcaggagaatggtgtgaacctgggaggcggagcttgcagtgagccgagattgcgccactgcactccagcctgggtgacagagcaagattccatcgcaaaaaaagaaaaaaaaaaagaattttgaaatggaaatgtatctatttttcctttctttagaaaacaaacagaaaatgaagccaacatatctcatcacagattgctctttaaatatgcgaccttataccaaaagcagacaagttcacaaagagattatttttataatttaatcacagaaaagactagactatcaggtagttggtggctacagaagtgactgctccccactgaagcaaggaatggatagaataagtccttgaaataaatgctcaggtcttcccttagtaattctggacagtggggaaattagctcattcaaacaaagtttattaaataaataaaatcccagcacttgtctctttagacaaaaaccacatggaaacaatacaaaagattgctaatgctttggcaaatgaatcactcttccaaatgccatttacaaaagcccaccagacctccagctgtgctgatgccatgggaacccctagggcaattataagtggatttaactcaagaccagaaacacaggagtaatttttaaagacccaaaaacttccaaataaataaatctggaaaggaattactgtttacaccacagagccacaggttcaaatagccaaacttaaagaagaaaaaacacacatgtatatatctacttcatcatgtaatctctgaacaataggaactttactgagttgtcactaaggaaagagcaaaatctaagataggtagtttctggaaaatgaaagtccagagaaacttggccataaaatgaaaattataacggacttacagagctcgtcttctttgggttaagaaacaaaggtcttcttgtgcaaaggaagaattcgaaagaggaattcttaagtagatggctgatgcatccacgtctaaacatccaaaatctaccaagcacctattacataactaagccctgtgtcagaggctgtggaacaagaaccactaaaacttatctctgacctcaagaagtttatagttcagggaagtgactgacaatcataatacagaggcataagggctatccaaatagggtcacaggttacgctatgaatacaggtatcacatcagaaaattaccgtacttaaaatctcagcaaagagatcacaccctcacacaattaatgttatcaacatccatccagtctctcaagctcaccctcttcaacaatctttgctttactgagttccgggtggactatttaaatatcatacaaattgattctgacatcacaatcactgcctgcttcctaaaacttgccctccaccgtctattataaatgctttccaatcagtgctcccattcttcattctattcaccacttagttactagaatgtttttctcaactatgaatctgacttcactccctttcttgaaaacctcctgtagttcctgttgtgtacgggataaaggtcagacaacttagtatagcccagctcagtccagctagcaaagcaaatactagctttattccctgcaagcaacgtaagacaaagacaaccacactaaactcagtattagcagaccaccatcctccctgaggcctccactgctttgcacacactcttctctttctcagaaggtcctttcccctcctcctgttggtgcagccaattctttctcttccttctaatgcaccatcttctgtgtagtcttctttgacactaggtagggttacatctttgctctgtgtttctataacactcttcatatgccatggaactgcattcattatattggtataattttatttgtcttttttcttcctagactgtgagcccctggagttcagggaccatttcttaatcatattccagaacctatcacaatgaatgacacgaagaatatatttgataaaaatctgatgaatgaaccactctaaaatgcaactctaataaagaaaattactgcctattcagttggaactgtaccatgttacaaacgtaaaattatgtatagtctgataaagaaatactataatagccttggaaacagctcacatacaattttttttataaatggattcattaccatataactggaccagcttactgaagagtagccctacagcagtcacttcgcagtttgcaattcatttgaggttcaaagctagctcaagggaaaacaacgttagtattaacaaacttatttttaagcttaaggtcagaatttaagggaaaataaataaatatagtatgttctaagaatccaaaggaatttttaaaaattgccccctgcagctgtaatttctgcatggatgagaaaaccttaattgcttgctggcttccaagaaagccattaacctgcatttaaaaattcagctttcatcaagaacaacctcacatatccagctctcatggaaaaaggaatagaagcctctgacctagttttcaattattaccaaactactgataattgatctcctggtctccaggtttgtttgttttactaaaataaattccctctggagctgcaggtgcttaccatggggctgcgcaggtggaaagcagcccagtcttactatgaggatgtccgtttgccatctgggaacaaggaggaagaagcagagacctgggcaagacctcagagtaagtgtcctttttggcggctcccaggggtccccatcatgtgttataggaaggcagaattatttgagataaggataggagctgaaataagcagtgctaatactggttaaaagttggtgcttcagctgcagtcacaacagataatgtctcttcagttatatttccaagctatttctcatttggcaatgtacacttacaccaaaactgtgaaactctcggaagtggcagaccttggcaacaagtgaatggaaactgtgaattacagtacatgccactgagtaaggggtgcacatctagaaaccagaaatcaggttctgtcttggctcagcgtctaactagatgtgtggacttagacaagtcatttaaccattggggattcagtctcttcatctgtaaagagttcatttagatgatctcttaagtccctaagatccccattgttaggtccagggtcaggttccagcccatgctgaggccggaagggagtgggtagatgaatggcagacagctgaaagaacactcagggggctacgggtaggtgaaatacaattttattcagcagctctcttacactgtgtgtctcggctgcttgttccagccactcccaagcacagatctctgctggctctctctccctttggggtcaacagcttaactctttccctctgagcgcaagcaagctgagctgtgtcctggctccccgctgcaagacagacagatctggtgctctctctctttctttgggtgcaagcacgcctgcacagtgtcaccagggcaattataccttttaaagacaacagtggcaaagagccaagtgatggccctcccatgttatggctacatagctgtttatattacacatggagttgcgcgcctgcgctacagacttgctgagtcacccgggatgtttacctcagcccatcctgcctggctgcagtgcagccatgttccttacacctaccaatttaaaagtactgtaattccattttaagggttctaaaccatgaaccatgttcatggtttaggattttagatatttctcatttaaacttaggagcgaactctgcattaggacatttctcctttcattgtccataagataactcaccaaatccttgcgcaaagagaaacaaatataaactacataagaaatgacaggtgagccttaccaaggaccctgacccatgcataacatcttagtatagcatatatatatatagtatatgatagaaacatgccgtgggctttcataccctctacaatagttcattataagtttcatcccccaaagaaggcaacttacatacttaagtttttctaaatagaatccaggtgctttcaccagtgatgctctccaagggatcccatcatagtaatcagtctagccagtgccaacttcagttctactaaatttaatgccctcttattttgactcaggaataaattatctcaatggctacttacatggtccagcatagcagaaaaaaaagccacactgagcaagcagtggtcctttccatgctacacaagcaagaaatgcctataaagacagacttgagtgcagtctaaagaatcttttgctttgccttaacactctacttctggatatccttgctcaaaaagaagtctactcaaggtgtgtatctttcctctttataagccctctggcctcaggaagactggtttcattcatgtggtcatgtttttgcacagcttaagactaaactgtatgatccttccttctgggctcctacaagggcatgccaaagtcccctcaaataaccaaaacggtgcacatcccctttgcgtcccacagcagtctgctagtttatgtaataccataatgacagctatctggagtggaacagtgacactgctttttcccagactacttcaccatgtgaggtaaacggtagaggcagcaataggtctgctcagtctatggctaatacaagaccttgcttatgatagacttcaagagcttcttattagccagctgttaattcatacaaactgcacagaaattcattctggagcaatattatttgtttcacattatacttaaccttgaaaaggttagtttttcaatgggggatgattatcctggatagatgcataccccctacaaacatgaaactggcaagttcactaaagatttctcaagagccaccaagctagcaaaagtcgcaaccaaataatattatatactctgcccttcagagcaaccttcttcatgctgaagtcttcagttcacagaatgactgacttattttcaaaagaggaaggctgtattgcatattgtaactctctccaaatctatacttatgagctaattcttcaaaaggtaagatcaattaccacacagaaggagaagccatccattttcttgaagctgtcaaaatttgagctgtctcccataggatttccactgacagttaatgaaaaaaatcagtatctgtcaattttggaagaaatttaaaagtggtaagatattcttataaatcgatgttaaaattttggtataattattgtatatttggattactttatttgctttcctccaaatcatttctttactaaatttccctaagttagcttaataatgaggttttcttaaggagaaatctgttggttatacacataaattgctaacaaaaaagggatcagagctaaatggatccaatttttcctccttcatatgctacaatacaaggctactgcagaatttacaccgtgaataatgtgtattttgaaaacccaagcttagaatagtagtattttgtttcactatcaaaagacaaagcaaaaaaataaaaaataggctacactaatgtacttttaaaaatatacttggaaaagaaacgaaactatttcatttaatgctgtcttatagaacagaaatgccaatatatttacacagaaataattcagcatcttgaagtataagtaaaaacactaatgaagaccaaatttttagagttatttcatacaaatagaataaatttaggcggggcacagtggctcacgcctgtaatcccagcactttgggaggctgtggcaggcggatcatgaggccaggagttcgagaccagcctggccaacatggtgaaaccccaactctactaaaaatacaaaaaagttagccaggtgtggtggtatgagcctgtaatctcagatactcaggaggctgaggcaggagaatcgcttgaacccaggaggcggagcttgcagtgagccgagatcacgccactgccctccagcctgggcaacagagtaagactctgtctcaaaaaataaataaataaataaataaataaataaataaataaataaataaaatttaataaaaagagactacccattgtttccactagaattgctgccaagggaaatataccttttaaggatcaaggcttagaattgcttttcgcttattagaataaaatctatcagcaatctgaagaaatacataaacaatcagcaaattctagttagatggctacaaactaggtaaattactaaaatgtgccacatgaagataaagttagtcttggtaagaacaaaggtttcaaataatttttgctcttagatgtttgctgacagataaaatagagaacttcattttcaccaagtaacgcaaagtataaaaaggcatcggtatagtgctgtgctgcttttgttaaaatggtacaaggaggaaaagagagtatcttctaaagtccttgaatgggaaagccgtagtttatcacgtcgtattatcactttctatttacacagcatttgtttctcccacagacagggaggttcctgtggacagaaacatctgcttcctgcttatcctgtatctcagcatctgaatggtcatgactggaacacaggcagacttcagaaataaatacataaatatctcatactcctcgaatcttttagaaaaagagtgtgggtaacaataaacatatctgctgagaaatgaccacctcactctactcttctgcagacttcccattctgtgccgagtcaccctcagtaggcctaagtgtgacgatcctctcagcactccctgtaaacctatttaggaatccgcgaaagaaagagaagaccaccaggcagactggtgatgatatttcttggggaggctgtgcagtttttcatagtgaagcctacaacttagattttcagcactaatagaaccccattatcaggaggagagaaaagcactaatttcagatgggctctgacaggggacagttttaagaatttatagagagacatttccgtgtccagccaggatgtaatcatggaaattggatttaccttcccatccatgtgtaacaccaacatccagtggtttttcatgatactgaacaaaggcagcaatcactgagagactgggaaataaacaaaaggactgccccaatttattaagaaagcttccagaccacaatgaaggtaggtggtgtggagtcctgacaaggtaagttagcaccaacaaggaagaggccagcccccgatgggggagaacaattgttctgagagacagctaatcacaaacaacctgcttgtacaacatcctgttcccaaataccttgctctgcatataccccagcagcacaatcctctctgcacataacccctccagcatggccctagaaaacttcctttcagcccctgcctcttggcagacagcctcttctctgctgtgccggccattgcttcccgctaataaacttgttctcgtttttgttgttgttgtttcgagatgaagtttcactctgtcgccaggctggagtgctgtggtgtgatctcggctcactgcaacctctgcctaccaggttcaagcaaatcttgtgcctccgtttcccgaggagcttgggattacaggcgcccgccaccacgcccggctcatttttgtatttttagtagagacggggtttcaccatgttggccaggctggtctcgatctcttgacctcgtgatctgcccacctcggcctcccaaagtactaggattacaggcgtgagcctccgcacccggcctaaacttggttttaactcgcacctgtttcagtaaattatttacttcccgtgaagccagccttagccagtcacgctcacaacaagtagaagccaggcggagcctgaaggaggccctgagttaaggtgacaaagttgagagtatagggagaccaaaaaaggctagagtttacaggacagaataccagagaggaaagaagtgtacagggagagaaatcaacaaatctgcagaaggtcagccttaaatattccacggagtactaatcagcccatgcacatgaacatactgcctgaagctgggacaggaccagctgaaagagttagaggtaacagtagcaggtgctcaaataagaccacgaatactgcctgctcccatcaaccagagtagaaaacctcaaggttcaaggggtattgaatagaagacccaaagagccttgcctcagtgacttgccctacactaaatactgctctggtcccacctaagaaagattaaaagcaagaccccttcccctacacacactaaataaaactgtttccaaataacttcactgtgttacagggggaaaaaaagctcaagaataatttgagggatacaaaaatagctagtacccaaaaagataaaataacaacatctggcattcagtcaaaagtcgcagcttcaagaggacaaatacacgtgcagggaaaaagcagcatggtttcactggacggcagtgcattttcactggacagttgtccccagtgtcatagatgaggtcactgatgacagaaaagaaaaacatttcttgaagaaatcagacatattacttttatacaactagtgctcatcaaataacaactaccatacagagagagaatgagatgactagcactggaaagagataatagatgagccactgagtactttcaataagaattaattgtaatcatggctgggcgtagtggctcacacctgtaatcccagcacttccggaggccaaggcgggcagatcacctgaggtcaggagttcgagatcagcctggccaacatggtgaaaccccatctctactaaaaatacaaaaattagctgggcgtggtggcacatgcctgtaatcccaagctacttgggaggctgaggtacaagaattgcttgaacctgggaggcagaggttgcagtgagccgagatcataccactgcgctccagcctgggcgacaagggcgaaactctgtctaaaaaagaaaaaaagaaaaaaagaattaactgtaatcctatacctcaagcaccctgagatggacacacacacacacacacacacacacacacacacacacacacacacattctgctaaatactgtaccatgctataaatcctaaccagtagagtacagctaacacttcacttctcactttgtaaatcacattgaggaggtttctttcacagcttatcttatgaaatggggctgaaacaagtcaacagattaaatttatcaaaatataaaacacacataatggatttggaacagaactgcagctgtatcttcactggctctcctgcagaggaagataccatataactcaatgactccttcttttaacttgtaagtcagtgaaaagaggcactagtttcctgttaaccactaaaccttgtccattatcttaaacatagaatacatcaaaacacctgataggttttcagtgagaagccctcagctatgctatcttactgtcctgaatcacaggaaaagaaatatagaatattaatgagaaatagaacagctttcatacatagcacatataactagttagccaggcccatcaacatgacttggccatcatttacagaaaaatagtattgctttaattaattaccacattttcaaaggttaagggcatgaaaccaatcagtcagcttaaaccttgttcctttcaacaaacgggaaaattttcacaggcaatactttaaaaataaaacaaaaaaattagactgctaactgactccaaaaccaaaattcagtcaaaaggcattaactcccctgaattttaacaagaaatgaaatggttttccttaaaaactcttactccagtggataaattataaatattagaatgaactgcaaaaacccactagagcatctgcttttctataaacacatagaatgtctactggaaaacaagccccactgaaagctgtactgaattacaaataatccactctacacttgcttgtcagatcttagaacaaaacacacaaatatatccacttcgcagtatctgtataaatggacaagtagaaatccgaatcatgttatctgaaaatgttttgcaatcatttttagaatttaataaataaaagataggactttccactttcatttccttgtagtgtatttacattgcacagcaccttccgttagaaggaaccaacacagatgtgggctttctagttggtttctctgctgcccccttctgcttcaacaaaacacagtaggcaggcaacccagatgccaaaaatacctctcgaagccaggtttcgcagaataaacaaatccaggatgactgattatctcattttttaaaagcattttcatattacaattgaaattatttcacgtgctttctgaaatctgatccaggtgtctggttatacaaactcagtaatgacaaggtaaggtttccctcccactcctgaccccagtgctcgctcttgcgcactctctctctctcccttcaacttagaaacccactatgtcatgcaggcagccagaaacttcaagaaccttttttatttcaagttccagggtacatgtgcaggatgtgcaggtttgttacgtaggtaaacgtgtgccatggtggtttgctgtgcctatcaacccaagaatcttttatagtaaaaacataactactttaaaaacttggttctttcatttccgaaaaacagtagaataacattatttctttgcattggtcaaattacatattctttctgtgacagaatttctttctgctaggaacttaagagataatagttacaatatcacgatcatcacacatagtacaaacagtataggtcctaggaggcaaagaccaataactgtgtaatgctgataatgaacttttaaaggtaagggactacacaaacaatagtgattccgaaaatgctcagaatatatactgagcaaaattctctgcaacgaggtatataaacctgaagtgctaaaaaatttcacaaataattattttaaatacacactaaaggataaatttaaggtaaaaacagtagctgacttttagtttatttttccagaactcaaatgtcaggccaaaaaagtcaaagcagaaaacatcataaatgatacctttaaggttattcaaagagtgggaaatatttttaaagcaggtgagatttttccaagcagaaagtgcaccaaatactgaaatcacggaagacagaactcaactccattcctcacctcaaatgcaccgaagacccttagagacaccctagaagcctccattaaatcccatcaggaagttgcatgtgcaggtattatgtgcaatatggtgcacctgcaccccaatgatccaaatgcctcaagctagaaccatcactgacgcttactcaagaatgtcagcgatgggaaacattaaacgcacaaactgtggcgtgttcgtttctgctggtttcataccctttccaacaaatcctccatcctctgccagggaaatctttgtaaatcaacatctgatgagacacctccaggtgatgaaaaatgccagctagtctgaaatacccattctcccttcttccttgagactcccaatttttttttaaaatgtgtgctaaagagaagtgttgtatgaaacttcaccagaacttaaacttaaaaggtatgaggcacgtgctttttttttttttttggctcttctgcctttctttctcaatgcaggggtaatggctggagctccagcagccaccttgaaccgtgcaggaccttaaggatgaaagtcaggtgcagcacaaccaaaagaaagattgacatctgaggaccttctaaagatgcttctctagacttggaatacttccctctagacgtcatttatttttatttttaattttattatttttttagagacaaggtctcactctgttgcccaggctagagagcagtagcacaatcatagctcactgcagcctcaaaatccagggctaaagccatcctctcgcctcagctttccaagtagctaagactacaaacgcatgccaacatgcttggctaaattttttttttatttttggaagttggtctcaaactcctggcctcaagctatccttccaccttggcctcctaaagtgctgggattacaggcatgagccatcacacccagccaagacttctcctatttgagagtataaactgttgtatctttctgccactgtagttgggtctctgtcttgcagctaagtccaagctgtaactaaaacactcactctttttgttctttctttttttttttttttttgagatggaatctcactttactgaccaggctggagtgtaggggcatgatctctgctcactgcaacctccacctccagggttcaagtgattctcctgcctcagcctcctgagtagctgagactacaggcatatgccaccatgcctggctaatttttatattgttagtagagacgggatttcaccatgttggccaggctgatctcgaactcctgacctcaggtggtccatccacctctgcctcccaaagtgctgccattacaggcataagccaccacacctggcctaaaacactcactcttgaacaactctctatcacctaccagaagttctaagccctgctgcctcgccagtttcatctcctgccatgtacgacatacactatttttcttaagaattctattctctatgtctctatgtaggagaggaaaatgtttcttttcttacccatcagttcgtggctgagatccctataacaaaagacagattgacaagagaaaagcatataaatttattttaatgtaggttttaagtgacccaggagccttcagaaatgaagacccaaagaagcagggaaattggtctatttttatgcttaggtctgacgaagaccagagagttatggggaagtgtgattggacaatgggaatatgatctaatggtaataaattggggaaaacttagcaacgcctgtttgttcacattcttcttggtatctctctgcctttgaggataaggatggtctcttctccaggtatagagagtatgcctctggaatgaaggatttataacttgcttcaggagataaggatgagtagaagataagagcgaccttcttgcttctgctgtttgttctaatgccatattttggggtagcatgtccggaaccccatcacttatcatgctccaaattttcatagatgaggggtttcactgcctgaaaccagaccttaatccaccctctactgacctactaaattcctagtcccccttcctaaactcaagggtcgcttcccgtatagtttttgctgggcctctcttctccggccctactgaggctctcctcttcagtctttctcctccttccacagcatcccattcacagtttctacttgttggattcctaaacatctgtatatgtcttctacaaatcaatgggctcttgagttcagggagtatgttgtgtccagttctgtatcttcagcacttggcataatgcgtggctcataatgacattggctagatggccaatattttgatttataaattatgggtcacaggccagccaaacttgaatgtgatttattctgtgaaatcatctccaacccaaccatccctcctgtgtgtttccagacactctgaatgtatttggggttagttatgtacacatctgtcttccctgctaggctgtgagatccagaagggcagggagcacgtatcacacaagctggtacccccacctctaagcactgtgcctggcttacaccacctgctcaatcagtattttctcagtgttgacaaaaatgactacatgaaggatggctttctttaatctcatgttcattccacgttgctacagtggggatacaaaaacgaataaaacacatttcttgctttgagaaggatacagtctaagaatattagaaaacatgaatacagcttttaagacagaacatcatgttgtgtctgcaatctctagcccctaatatgtactaaactttaaatattttgtgatataaagacaaaacaaaagtaatattttactaggacattatcctaatacataatttctcttgctctatgagtattttttttaagccacccagtaaatgtgtagcaacaaagaaccatttggaagttattccctgtcttgcagactgagtcagatcatggctaactgatggtcggtcctctctcatgtttcttgttttgttttgtgtttagggttatttctttttctttgcttttcaccattactatgaattttgaaattccttccattttgcaaaaaaaaaaaaaaaaaaaaagctttcctaattattgttcattataactgtaatcttttaaaaatgaaagagtccaaaattcatctaaatgtctgttaaaatgaacagaagttgacttaagatacagtgtagtttttagtctacatatttaattttcagtgtattcccagagaaatagcagtgttgattatctctctttcatgtcctaaaattaatagcagctcatactgaacccgtctaatggaaggataaagacttaccctccaggccagtaactacaaaatgactgttgcaggaagtaggaagaacatatgctggaaactggttctaaaatgagtaatcagtgatgtcattatagggaaaagagtgcagcgttaatgacagaaaccgggcatatcatctgtgacaagagcatcacaatatagcaaagcgattactacagagttctaatcaaataaaatatcacaagataattaaactttccatgttcagaatgaaacttcagttaatacaacacctacatcctctggagtggtattcaaaaatagttcaattttaaaggaaaaactctcattctccaaaatttcaaatataaatatcccttgcagaatgaacaggaagaaaagactaattaaaaaaaaaaagaatctccaatattctttggagataagtagacacacttataaagaatgcagggccaggaaaggtagctcatgcctgtaatcccagcactttgggaggcagaggcaggagaatctcttgaggccaggagtttgagactagcctgagcaacatggcaagatcccatctctacaaaaaaatttaaaaaattagccagcaatggtgatgcacacttgtagtcccagctactcaggaggcgggggcaggaggatcacctgagcccaggtgtttgaggctgcagtgtgccaagagccaaggtcgcaccactgcactccagcctaagcaacaaagagagtgctgtttctcaaacacagagtcacacacccttatgaaggtgtattcgtatatgacagaactaagaattctgaaaactactacttgctaccatatggcaaattaccaaggctccgaacatctgtcatgtatttcaaaaatgattcactaaatattaatcccattacatgctaatgaaatatccctagttgccaagtaattttcaaaaatgcaccaactaattaaagaccaaatcacatatttgactaaaggacacgtttcatttaactcttagctggacactttcattgaactctggattgcccagtaaccaaatgtaagatgacattgtgtatggtgaccaggccgaactcagctgatgtcctaaccaaggacaccaaacaaacatgcccctgctctccgggactaatttcacatctgcactgaaaaacacaatgaagggcgtagccatgattaacttcaggccaatcaaatggctcccaaaagaggccaattttaaatctatggatcacagaacttcttcataggaagtttctgtcaagggaaaacatactttgagttttttgattttactttgatttccgtgaaacactctctataataccttatagagctaaagagaaaaattaagaggagataacagactgtcctttacaatgtactatcctcttttaccctgttctctcactgaaaattgaataacaattacaaagttcaaaatcacagatatctgacatttggaagtgccagaacacctttcaaaaaatgagctgaatatgttcaaagcaatccaaaattaaagagaacttcaaggtgcaagcaggtgataatctaaacggaagagccatctgatgcaacagcctacatcattctgcattggccctgcatggtggctcacgcctgtcatcccagcactttgggaggccgaggtgggcagatcatgaggccaagagatcgagaccatcctgaccaacaatggtgaaaccccatctctactaaaagtacaaaaattagctgggcatggtggtgggcacctgtagtcccagctactcgggcagctgaggcaggagaatagcttgaacccgggaggcagaggttgcagtgagccaagatcacgccactacaatctccagcctgggagacagagtgagactccatctcaaaacacacacacacacacacacacacacacacacacacacacacacacacaaatcattctgcactgactttcctaatggtggcagtccttgggttccatctttttatttttgtccctaataaaattgaagctattaaaattgtattacatgcttgtattgttttacataaggcagtatgctaagtccaaaatgcctaattaaaacattacaaagggatgcatactgtccatttttcttgtgttttttttcccctgagaaatgcacaattttacataggaaccgttaacgaaatggcaaccctagcacccaaagatgggactagtcctgcatctgctgccatcagcctttcttcctatcaacgcctcttacaagtcatgtctgtcatccttgtcactatatctatatctacgaatataccacattttctttattttaaaatctctccatttaagatcctttccacaaaagatgttgtcttcgtatttacctcactgccaatgcttaaaccatattttgtgtataacaaagtcaataagtgttgaattaatgatgaattatcctatcactattattgcaaaagcaactgttttaataagtgataaacactctctttaaaaagtacctttagcctgtgttctagtctcagtattgtcactaattggctgtggatttaaggcaagtcacttaacctctctagtttgtttcccagtctgtaaaatgtggagttggccaaagtgactatttaaaaagttccaaatgaatgaatgaatgaataaaaaaagaaagaaagaaagaaagaaaagttacttccagcaataaagactacagctgtacgagttttttttaaggttttatcaaccaaatcactaagtctttgaaggtaattaaattgcataaaatccaaagatgctgtccacaaagaaggcgaggtttgaatagagccaacttcctaacatgtacccatcacctattaggtgcaaaacactgagctagtcaatgtaagtgcaaaaaaatgcctaagactgtccctcagttttccaacctaatgagatagatgaatgagtaaaagagtgactacaataaaaggcagatgacataaggccggagagggacacaagcagcataatttaagacagaaaataaccaggtgtgatggcttcagctagaatatatcttggttgagaatgtatctgatgatcatacacagaggcctggacaggcctcaccccaggccacccatgacactgtaatagagtgatcttttctacttaaaacaaaatctgggcggatcatgaggtcaggagattgagaccacggtgaaaccccatctctactaaaaatacaaaaaaaaattagccgggcgtggtggcgggcgcctgtagtcccagctactgggaaggctgaggcaggagaatggtgtgaacccgagaggcggagcttgcagtgagccgagatcgcgccactgcactccagcctgggcgacagagcgagactccgtctcaaaaaaaaaaaaaaaaacacacacacacacacacatctggaatttcccttatggagttatgatgtctcaatgattacggaactttactacattggtaaagatgttgatggcagcatatttaacactgtgaatagtcttccttagtacttcatatattgaagttgaatctgcatcccatacccttcacaaacccctgcataatgaatactatttaagtcatcagaatataactttcatcatgttaattttatctgaagaatatgcactggctctttattgcctgttatgccacattcaaattcctcagacaaaatcccactgtacctatgtggtaaatggggtaaccatactatgtatgacaagtttctatgacaaagaaacttgagatttctagaaaccaggtctttcagatacctcttcactttgatatagataaactaaagaggaataaacaaataaaatttaaaatttttagctatttaatattttaaaagtaatctactgagtatagaacagtttttaaagttcagctgaggaccacgatttatgagctcgaaggaaagacatacttcgatggagtggtaacatataataaaagaccctttggtaaagctaagaggaataaaagaaagaatggcaatggcaaaaacaagagggatgtgatgacgatcagaagtggtgagagggatcctgaataacagacaaatatgggcaatatggctatgaaccttagataacgacagagaggaaaacagccaatcaagcaatcagtccatcaatgaaacatcaccaccaagaaaacataatttgtaattcgagtagtagtaaaaaggagtggcaactacctatccactgtatccattttatacacaacaaactttgaggaatctataagatgtattggaaggaagagactagagggttagaaaccatcggaacagcatttcagtatccccagaagctatcagccagccatctggaaagtgcttcaagcagaataattccagagcactaagaagcattacttacacacagcgcagtgccgtgccaagctaaatcatggagcaacacagcactgcagcttggacaggatccccatctgggcatgagcactgcaaaggagctttagatcagtggttctcactgggggtactagggaccattttcagtattttcaattgtcacaatggcatgtggtagactgtagccaggcctgctagacaggacagccttagataacaaataattacccagtatcctccaagtctttcagatgttccaccagacttgccggtaggtgagaaaatcctgttacttctttgaatatagagcctaactgtattttacttacagacacaagtgtttcttgcactgtttagtagtcactgaattatcaaggaatgcaacatccttaaatgtaaattgaagaggaattatactttgttttgtttgcaattgtaccaagagttgttcatcattgtgaaaaatcatgtcgacaattcatggcatttcaatcaccaacacaataaccaggcatcaatctacatacacagatgttacatttataggattctatgtatgtttatgtgtatacttatttactccttatttcaaagcttcaaatagaaagaaaagcttttgccaatactcagttgaatgttgttttactcctctttaatccaaatatattcattgcaagtaggtccaaacatctgatgacatcattttatctccaggaatagtcaacaagtaagcatttacataataaaatgcactgaaagctatctttctcttttctttatattaaaattgtaacactattttaatacttaaatttatgtgtagaggcagttatattattaatacatttcatttcagaaatgaaggggatattccaaaacacattacaaagatgcagcactgaatctaatagggttagtaaccactgctttggatgcacagagaaaccgtagagagcggattccaatgtatctacacaggaaggtaaagtgcaaaagtaccaaaaggtgatgctagctctgtaaaggaaaatatcatttgctcatgattagaagagagaaatacagattaatgccatatagaactctgaaagggcagcttttcctgttctttgaggatgcttggttattgtaagcggtcacaaggcaccagttcccatgccaacctgagtcaactgcagcaccaaaccatagactgcataaacacctcaatatttctcattcacagaaaaggtgagaacttttttgtcaataacttcaacaaagatgagcccaagtattttcagaaatactagcattttagtgtgatgatactgcattggaaagttggataaagtagacaaaagatagttgagaaatcctgtagaagaattctgtattttgttttagtattttgtttttaaggagctaatttctagtttgttttcttctatttctgttgtctgtaagcaaaaagaactaatttccttactggtctaatccctaaactcactgcagtggaaatgagtgaaatatgaaaaggaggctgggtgcggtgaatcacgcctgtaatctcagcactttgcggggctgaggcgggtggatcacctgaggtcaggagttcaagagcagcctagccaacataacgaaaccccatctctactaaaaatacaaaaattagccaggcatgatagcgcgtgcctgtaatcccagctactcaggaagctgaggcaggagaatcacttgaacctgggaggcggaggttgcagtgagccacgatcacgcccctgtgctctagcctgggagacagagcaagactctgtctcaaaaagaaaagaaaagaaaagaaaagaaaaatacgaaaaggagaggagattatatagctaaaatgagtgtaaacatagattataatttccagtattactattttaattattagtattaagtatgcatttattattatcatcaacttttacaaaatgcagtaagggtagaaatgtaggcgtaaagcaaagccctgtttggtagaacaaaatcctacttggtagtaacaataacaatcaaatacctccaagtcactgttgaaatgttgtcttctccacgaggcctaatgtgactttctatgtaaaactgcaagttgccccaattcctgcactcctcctccccatctctattacgatgttcagttttatttcatagctcttaccagtttctagcatacaaagtaatttgctcatttattatggttatagttgcctcctacctctagaatatatttctatgaggggaggaactgttcactatacagtccagcatgctgaaaagtgtctggaacagggtaagttaaccagtatgtatttgtggaaagaatgaacaatagcacataccatttactgagtgctttctatgggccaggcacattgataagtgctttacatagaaatcttatttaatttttattataaaagcctgcaaggtaaatattatgaatcctcagttcatagatgaacaaactgggatttagagagagtacaacagctgttctacatggtacagccagtgagcagtggggctggccctcaagcccaggcagtctgacttcaaagttccatactcgccacaacagaaactcagtagagctcagatactctttttctccctttagggggtgaaaggagtatctggattagtcagctccattgtgcgtgtgtgtgtgttgtgtgcttttttggttttgttttgttttgctttgagatggggtctcactctgttgcccaggctggagtgcagtggtgcgatcacagctcactgcagcctcaactttccccagctcaggtgatcctcccacctcagcctcccaagtagctggaactacaagcacacaccaccacaccctgctaatttttttgtatttttcggggttttgccatgttactcaagctagtctcgaactccagggctccagcgatctgcgcacctcggcctccaaacgtgctaggattacaggtgtgtggccctccccactgttgatcccattcttgttcattgcgatccttcaaaaaatatgcaagatggaagacaaggtgcaggcaggggacagatggggaatctttgtgtcttcaaaatctctcaattttgctatgaaactaaaactgctctaaaaaaaattaagcctttaaaaataatgtcttaatgcacttgtatttctgaatagttcaattttggggtcatgaaagctttaataggtaattgttgacttaacacctttacaacaatgaaagatttacacctaaacattacatgaggtaaaaggaaatttattcatcaaatacagtaaaaaaaaaaaaagtagaaattaagaatagagtaaagcatggttgacctcagcttttttgtgagagtttctattttctcatttggtgaaactatctttgagggactgacctttcgacattcagcgccatttcctttgactcctggcatcttctgctgcatgttcactattcaaagtagcccaaagggaaccaagacagtccacagctattgttttgccatttaatcaaacctgaataaagagcttgtacacataaggaaagtaaaaactcactagaggttacatgaaagaggctgccatggagaggactcgtctgttcacgtaacatgaataatttccccatcgagttgagaaagttctgaacacatttctttctctttttttttaaagactgaaaaatggatataagcccatagcacttgttagctagtcaagcaaagagtgtactcactaaatttgtgcatagaaacaatcatgatcccacagcaaaaaatacttccttaccatgcccttcatagcaggcattttgaaaactgaaaattctgccaagtcaaatatataactgtagctatgtctacttctgtttaaaggcagagagaagaggaaactaacaatactaattccataatttcagaatgagttgcaagtacaatattggaaagaatatcctcagaaaacaggttccccagaggcaggtgaccacagcaagtcatcaggagaaaaacttatatgttcaatttttctatcatcatagaattcatcccatcataaatggagggaactcttcaccttgagaggctacaatttaggatgaaagttttaacgtttaatatgtagacaaaattatcactaagatcatttagggttgtccaacttttcatgaagttcccaggcctccatattttcagtgttataaacacttgagctcccatttataagccctgaatccattttatgtctcccaaaaaccaaaatatttaaattaaaatacaggtagctcagattgactgtctctcacaggaagaccatttatgctaaaacatgctgattcttatagagtgactacccttttaaaattaaaaactgcatcagtgaaagaaaattacaacctatatttatcattcaaaaagaagctagaaaccttaagtaaaaacagggcatttttgttttcaaaaatccaatttttattctcgttatataacaaagaattttaatgtctccctaatcacaaaaagaaaatgctgtttggattaaaagcagtagttacatgccactcattgcactccagacagttctgacctttttgtaagagaccaattttgtatttcctttctcctgcctgaactattgcactggcttgagagttgggctccttccttccagtcttgactctctaatctatatttcatgccatgaacaagaattatcgttctaaatcgtcataatcatttcattctcctacttggaaactttaaacagctctttacttaatagagaataacgtccaaacttcatactagagcactgaagcaaccccacaatcaaacctcgtcttaacactcctagtcctgtacactacacacactctatgctccaaggactagaagcagataaagtcctttccatgggctcaggaaccttccttgtgtggcttcctcattccctccacttggctgctgctgaaatttaaaatcagcacatgttctacttttcccatgaagacatttccagttctcacagtcataattacttatgtcttcctttgcattcccaacacacatacattttatcttatcatgattagtattatagggggttgcctccattgccctatttccctctattgtgtgagatcaaaggtcttgtcgtgtttaattccagattattataacaaaacactgtgtacatggtggtggctcaggaaatgtttgctaaatgaaagaatgaatgaatcatgtaaacatccaatcagtcaatcagtaagaaggaataagggtgaaatgttgagtcaaagacaggactttgagtgcctgcactttcacttagaagaaccttaggttcttattcataaggctgaccatgcctgctctaccatgataataacaaggaaagaatatacatttccgttacttcatagtcaacccaaaatgatctgagatgtattatacattcccaacactgtgcggggcacattgagagacagaacataaatttcggctataactcttactgattgtcttttgtctattgaaatattcccctcctgactacacaaattgtttctttaaaaaggtgagtttgaaccacaattttatgatttatgcaatgataaagtctgacataaatttccggagaagtctagaactggttattaaacaatgatgaacacatatgaagacaatgaccaattaaagacagaacattttcattaaaatactttatatgaaactaaatattttcccttttttatatggttataaggctgaaggtcagaaaaagactataatgtttaaatgagaaattcttgatgtccttctgagcacaatgaagaagcacaggggaatgatatcagttatgtttgcaacacacccaaacagtatagactgaaaaatgaatgttgaaattcaatttttagcactatctctaatgggctgttattaagtcctggaattgggacaattctactaaacatgcccatcggcgacttggctgagatcataaaaggcatgcttaccaaatttagagatgacaaaaaattgggagaagtagtgtatatattaaatttatatatttaaaaaagctttacaagaaactcatcagattggaagacgggcctaaacaaacaagattacattcatccagattaaattccaggttctgaatttatgtttttaaaaaattaattgggttatgaaaaaaacaatccatgtacatggattagaaaactatatggtcaaataatctttaacaagagtgctaagaccattcaatggaggaaaggacagtctttttgacaaatgctcttgttaaaactgtttatctacatgcaaaagaatgaagttggatgcttacgttacaccatatacaaaaattaaagcacctaaacaaaagacctaaaactataaaactctcaggagaaacataaaggaagtcttcatggcattggcttgagcaatgattactcaggtatgatacaaaacacaggcaacaaaagtaaaagtagaaaaagtgggctacatcaaaattaaaactgctatgtatcaaagaacacaatcaacattgtgaaaaagcaatccatagaatgggagaaaatacttgcaaatcatttatctggtcagggtataatatccagaatatatggataactccaaaactcaacaacaaaaaaggaaaaacccaatttttaaaatggggaaaggactcaaacagatatttctccaaagaagaattacaaattgccaacaatcacatgaaatgatgttcaccatcattagtcattagggaaatgcatattgaagccataatgaggttgccacttcacattcactaggatggctactatcaaataaacagaaaagaagaaatggcggcaaggatgcagagaaactgaaacccttgggtactgctggtggaaatatgaaaggtgctataataaaaactacaaaaaacagtatggcatttcttaaaaaaacataaaaataattaccatattatccagcaatcccatttatgggtatgcatccaaaagaactgaatagtatctagtatagtatctagaatatataaagaactctcaaaactcaagtttgaacaactgaacatttgattgaataactttcccaaagcttgtcatttaaatgaacccacggcatgactgagggaaaagcagaacatcataagattccactcccaggctcgtgaagttactgaaaacatctattggtccaattcccaccaagttgggaaaggatgagaatgtttcccataacaaatctccacactttactcaatgaaaaacctgaaaaagtaaataaataaatacttctaaagacctgagtgttgttaaacttattatctaatgatagtatctcattgttccttcagtttttaatatagttttccttagttaagaatgtacaggaaaagaagggccaaaggggcctgttgcactgcttacctcaccagcaactatcttcttgatatatgtcatcacgattggctgatactaacggaagcaggggtgtggctttattaaagtgcatcaggagaaacatcttcttaaggaaatgccagcttttatattattttataagaagaaggagaaagagggagaacacatgtgcaagcgagctgaatgcacacacgctcaatgaactcaactactgtcaaaaaaaagcttgaaaacatttcactattttataatagccacagctgagccagcaaatgacactgttgtagctactatttatataattaaaattataccctaacatttcattttagaactccatattaaaccacttccatctttaagctaaaagcacttcaaaagaaatgtattcttgttatggtcaactaattaaaagtgcattgtatctggaccagaagaacctatttccatgcacaggctaaagacagcccggggaaatgactagtgaaccttcagataagatgacattttaattttcctttatatatcacatcgcctacacctagcttcataagcatgtcagctcactttgtcacctgctgtattacattaagaaaatgtttttattttcccaccttttcttctagaagtggcctatgactgacatttcaggaggaatagccttacttggaaatattctcttttataaatagtactcccaaagtctattccaacctaagctccacttcaacataatttaaaatgcagctttctatataaggcattttatatatgtttattaaatgccttataataaacacttatgtattcaattcagctagatcatgtatatgattcataagtaatctagataatttataaattttatacactaaatttaaattatatacccatgattttcatcacataaattaacacatactatttatatgcccctagcagaatatgcttcagaatccatgaatccattgaaataatatgcaaattttatatctgtacatacatgtgcttagctttccacagtttctcaaaagaatctgtgaatcaaaagaagttaagaaccactagtctattcccaaatgtccatcatattatttaaatataagcagcatctctgaacaggagacataagaccctctgacttttagagggttaaataaccatgcagctttccatttgcatctacacctatatgcaactgaaattgattgaccacattttcttcccccccctgccgcttttaatgactcatttttaatttccacttcaatgctaaataatatctatttttaaagtgtgcttgtttgcatatcacaccaaactaaaattacatccccaagaaaatgttcccagtcaagctaaaaaaaaaaaaaaaacttagcatatatgctgaagaggctgctgtttggtaccttggttagtgctgaagtaggcaggaagagctggaaatgcaaaacagcttctctgacttagaattacatcaatattacagttcaggaaaatcacattatttaaaactataacatgctcataaaaattcaaaaactggctctttttctgttacaatatgctgaagagctacagtgattcagtcatctacctgaaagcttttgtttcaaatcctttctaataggtctcactactcctctgtgaatggtttagagtaggacctttggtcccattcatccttctatgtggagcatcagacacagtacctgcgaacacaaagcaattcaaaaagttttttattaattaatattgtatgacctaattaaatcctaaaatttaagcttctggaagctatcccagtgtgcacagcttaagtatgttctaaaatgacagaggggcaaaagtaagccatcttagggacatgcgtcaaattattccaaacaactatcacttccagtaacattcctgagtcatctcaagataagtccatgctggcaaatatagaagtcattaggcaaagaacataaatttgcttaagatgcagaggcaaaagtgatcccaatatcaatcaccttaaagcttcataattaaaatgagtctggcaattgtctcagacacacacacacacacatacgtgtatgtatacaatgtatacatattatatatgcataatgtatacatattatatatgaacagagtagaaatatacagctaaaattgttttaatatacaaaccaaaatgacattttaaataaaagagaagcatatgacatcatccaagtagaaggaactgctaagagtcatctagttcaaactctaatctggtccattacctttcaagcattcaagtaagttttctgtcctgttttttaaaggcctctaggattgtataatgtatatcaagtgtaaggctttccaaaatcatcctttattcacttatgcaaaataagaaagaaaacaatgtgagaaaagatgaatattctcaaatctggcagtgcctgctgataacttctcactgttagatcagagagttattggtactgtttgtcattcatgtcctgaaatcttcaagtacaccaggaactgcacatgttcccaaaccaccatttcaaattagcaccaacagattggagttaatggcacatataacacattctgcagaatttaaagctttcaggccagctctaataggtagctgtgccttgatttgtggttattatcctacaataacataaaaattagctatccaggtaaagagtggctctccattttttagttggctacccacccccaattccaaaagcataggtccatcatgttcagattttaaagttgaaagaaaggtagacaccttagacacctcatggaggagcccggagacagttgtgaataatgctgccccatctgagatagaaccttcttttgttatgtactgggcacttaaagaaaaaaagtacaactctgtaatggcaaaagaaaggtgcaaaaaaatgcaggatagaagcagggccttgagaatatatctgggagttggaggaagaaggtgggaaaaaggctgagacaatgtacagcatgggctctgcagactgggcagggagaacataacaaccagtaggcaagataaggaatacagttaaatgaatcaatgagtgagtaaatgaatgaatgaaccaacataggaaccaatgaacatacaaataaaatgaatgaataagtgaatgagtgggcatataaatgaatgaagttgctgaatggtaggctggaactaagatgcagacagtcctaaatgtcatgtaatgagtctgaattcatccaaaaaagcagaatgagaaagacatttcttagacttctgcagagcacagtctgcccaactgtatgcacagacctaactaaaagcaatgagagttcacggaaagtttttaactctattaaatcagtcactgtggaagatcattcagggaacagtaggcagaggataagaaacagaagtcttacaacaggtccaaggactacgagctaagcaattgggttgttgtttttctgatcatgcatatactagaattttggatttgggtttttttaattgttatataagtcacgtgctgtaatattcatgcttctaaagtatacaattcagttgtttctcatatatttgcaaaactgtacactcatcaccactatgtaattccagaatatttcatcactccataaggaaactctggacctattagtggttactcgccatttctcctcacctgagtccatgggattcacatgttttaatcttaatattaatttctcctttatgtatctccccaaagtgcatacaaggacaatataagggtatctgcacaaagcagactctcagtaaaagatacatgattatctgccaaagaaatattgtcagaatgcaggaagtatcaagacaattttctttgctacccacctgatgcgacatttttactctcacacggtgagtagcaattttcaaggttcattaagttttttaaagtatcacttggtttcccaattgcaaaagtttaagttgtttttctccccactggataccataacaacctaaatatagtggccagatcaaaagacggtaaaagtagatggtgcacaactaataacccaattcagcaaccacagccttagatcatgatcgatttttccctccaccctacagagtgaaacaagttctgagaacgcacaggtgtttctctgcaagtccctgggcggaagtagcgggttataggataagccgatttctttttccattttaaagtcatctaagaaggtatttccattacattttgtatataattctactactgagttttggaatggctctttggtatttgggagcacacatttaaaaaaaaaggaaatctccaaattcctctcagagattattaccctgaattttagaacaaatttcatttaggctttgtatgtcatcccccattacacacacaaacacataattttttttcttatttctgttaaaaatgtaaaatacctttaatgataaaaagatattccttaagataattaaatccagctgaataaaaatatagtatgtatgtcttactcattttcctcattctgtgcatagggccaagggactaaatttacacatagcaccgaggctgtgcacagtcctcctctgtcccatcctcactccgccccgagtgctgcactgtgagaacaagacaccctcttcgtatatattcgctcactacttatgaaagatatttgcattaaaacagttgttttcataatactaagcttctaggatttaaaacaaaataaagcccgaactgaaaacaaaaaacaaaaaacctgactgcattttggtcagttcatctcttcctataaactattttaaaaatttatttatttatttattttttttctgagacggagtctcgctctgtcgcccaggctggagtgcagtggcgcgatctcagctcactgcaagctccgcctcccaggttcacaccattctcctgcctcagcctcccgagtagctgggactgcaggctcccgccaccacgcccggctaattttttgtatttttagtagagacggggtttcaccgtgttagccaggatggtctcgatctcctgacctcgtgatccgcccgcctcggcctcccaaagtgctgggattacaggcatgagtcaccgcgcccagccaaaaatttatttttaaaaaaagtttaaatactttgcacagtacctaaatttctttgtaccgctctctataaacaaatcatgtggaaaatattttctaaatgctcaggtctgtcaagtttgctagacataatctaatcccttttgtatcttctctcagtaactcaagactttgtaaagctgcaggacagttaagacaacagggacccaggggacagagccttcacaatcagtcacagcagccaccaaacccctggcctgagctatacagaggaaggggtttttatcttcttccttcacaatgcctgaatactctcaaggaatcctccataaataattcattagcagcaaaaagaatacagtctaatcaataaggagtaatggcgaaactcacagcaggttcaggggactgattgagtgttacattaatgtctgattaagcttcctgggaaattttaattgttcatagaccaaagacctaaaattaaccttttaaccttctgttataaagggtctttctcaatggaccaaaaaatgtttataaaatatatctaatgaaaatgggaggctaacatgagtatttcaatacatagattttctcaagaccacacagaaaaacagaacttggttgacttcattctacctaaaacattcctaatccaatcatattgtctaatatttaatgattattttccagtgggtgttataagagctttataacacactttcatttctcaactatcaattccctattttccaggaaaggaatttagcaaactctgcactctttttctctttttctagtaattccctttgtcaattcacagcaaaacaaactgcatgccataagcattcaagaagctgagtttgaaacacatttctttaacaaaaatgaaaaattctgattttatagttacacatgtagaattttaaattaaaaattgttgatatgtgctaatattacacagaaaatccaagatggttaacaatggtgggttatagaaggccttaatgacaggctatttctccaattttgttttgttcaagctaatgttaaaagaattgaatatttcatcacactctgagaagacagcaaagaatcctgctggaaaggaaagagcagctgatctaagcttttaaatatgccatggatagtccgcacaaagatatgaatcacctgtgtttcactctacaatgacacagctctccctttcattaagatatgaatcacccatatttcactctgcaatgacacagttctccctttcatcaagatattcttttcatcatgtattggttgatcgaagacaaaacataagaatggacaaatcattctttagttacataagaatattatctaaaccaagatctctttcaaaaggatcatgaagaatgcacatatatacaaatgagaagacttgccagtaatggtcaatgaggtacaagtgccaggtttctgctgaaatgcttggtaaaacaggtaaaaggatgatgggttctggggatcaggacctttcgcttcaaattccagctccaccgctttggatgtgcattattttggcccagacacttttctctaagcctatttcctcctctggaaaattattagtggtattcatcttgtacacgtattctttgggactaagaaaaaatgaaagacttacactttctagcaacaatataaggtcaacaaatgttagctttagtattagtactagcaccagtagtattagtaccgctagcagttactgcagctgtgcaacagagaacggaagtgtccaccatcttcattgaaggaactgctccgtggtggattattttcctattaaagtttatactttaaagcatcaaacctttttatcccgcccatttggaaggaaatgctatttatttatttattattttttagagataggggtctcaatctgtcacccaggctggggtacagtggcacaatcacagcttactgcagcctcaaactcttgtgttaaagtgatcctcctgcctcagcctcccaagtagtagggactataagcacatgccatcatgccccgttagagatggagtctcactatgttgcccaggctgctcttgaactcctggccttaagccatcctcccctctccgcctcctgagttgctgggatcacagaactgagccaccaagcccagctggaaggaaatgcgtttcaaatgcacatcacggtcactggcttagcagagtggagtctatcttccttggcaattcaggaccatctttaggatcaatacttactatcttatataacttatgacagtagaggtattgtcaggggctacccaagtgggcaggcttcattcaggtgacctatccgttcaactgctatgtttttcttgaagctggtgactctgtcaggaaaactcagaacaattctcagaaaggttcataggacactaaatgtcttagggtcacatggagctaatacataagggagcagtcacttgaacccaaaagtatctggcttggaaatcaactctctctaacaacccatactgaactcagctgtcactgtatacacacaacagaactggaaactctgcaaaagatctagcaggatttgaattccacacgatatgagcaaatgttgaacagggcgacaggatacagctaccaaaaagcctaatggtaaaacaaagacaaacaattatttctcaaattttatcatttgtacggatattcaaaggaattttaatgtcttaagcacaccttgacagatggtgcattcctatgattacttactttcattttactgtcctcaattctctccttcacagttatggtagccaacaaaagcaacagcagcataatgtctattaaacatgtacagtgtgctagaaactgtggtaagtcctttacagaaccacagcccccctgaatgtactcaaaattctgcagtaaatgactaacatgccaacgtaaacacatttaaaaaaaatcttcatttaaatttattaaacagtccagaattcataaagcaatgtaaaaacattcaagattccatttagtaaacacatctcctggaatacagcactagttgctgtttaaaccctggtgattgagttctatgttcagtggaagcagagtcgagctggaagcaatgaaagacttattttgaaacaaagttaagtttcctataaagaagtcaaattatgtttgggttcattctctttttcaaagttttcctcttccttactctcacatttaagaaattacctttaagcaaaaagaacttgctcagaagatagcagtcactaagaatcaggcatcaccggccttgaacctcagtataccacattcttttttctttctttagcaccagaaggatacctctcttctcgattcagtagtcccccttacccttaggggatacatttcaagaccctcagtgggtgcctgaaaccacagatagtactgtaccctctatactctatgctttttcttatacatacatacctatgataaagcttaatttataaattaggcacagagattaacaaaaataattactaataaaacaattataataatatactattcacagtctcatggatagattctttcttcctgtagatcttagcaacctcagcgtattttttttttctttccttattaagtcgggaactttcaccttttcactgaaggaagcactttacagcttctttttggcatatccaaattgacagcgctagtcttgcactttgggagcattattaagtcaaataagggttacttgaacacaagcactgtgagactgcaatactccatctgataactgagggtgactgctaggtgactaatgggtaggtcgtgtatacgcatggatacgcttgatgaaagaatgattcatgtcccgggggatacgggattccatcatgcttctcagaacagtgcacgactgtaaacctatgaactgtttatttctggaattttccatgtaatatttttagactgtagttgaccaaaggtaactaaaagcacagaaaatgaaacctcagataaggggggcactgctgtactttcagtagagagttctcgtaagtatattgctcttttctggacacctacaaacacaaattggccagaacatcatgaagcatgtttagtgtgaagacaagtaagaagggcttggtgatcttagttccaacctttggcagcttcttcatggagataaacacgagggtagaaagttctgtgcaagtctggctgtgcaaccagcctctcttaattgtgtaagacccacatggaatggtaagaaataattgccaccacaatggacaacaaaatctcactaatgtgaattaacaggcaaaaaagctaacctggattacattatcttttttaatggaaatacagttgtatatttaatacacacacacacacacacacacacacacacacacacacaaacatgcatcctccaattagactaacagtgtagagggtcttgggacctgcttaaaggatagggactcttagtgaatcatgcattactgcaagaaatacgtcttcccaaaggcttcaaaacaggtgcctttctttgtaagtttaaacagtgtccttgcagtcttgggtatacaataggattctaagtcagttctctccataacacattttgaaagaaaaaaagtcaaagcaggacaggcatggtgctcacacctgtaatcccagcactgtgggaggccaaggcaggtggatagcttgttcaagaccaaccggggcaatgtggcaaaatcccatctccactaaaaatacaaaaaatcagccggctatagaggcatgtggctacggtcccagctacttgggaggctgaggtgggaggatcacttgagcccacgaggtcaaggctgcagtgatccatgattgtgtcactgcatttcagcctgggcaacagagcgagaccctatctcaaatcaatcaatcaatcaatcaaagcagcactatatgaatcatcataaatgtcaaattagtaaggtctaaattctagattctgcttattcatgctttgggatcccagcctctatgcttctggatcctcccatctgttaggtcaacaccatttacctatatgtctagaagaatgctccactacatcacctcacagaagggcacaggatcaagatattgaacatttgatttaatgcagaaaaagtaactttcccaaagccttgtgctttccagccaggcactcgtttcctcacacaacagcagcatggctaaccaacagcttccagaagtacctgtaaagattgataactttagctggaggaaaagctggagattttcttctccattccctgactgtacttataagctacttactgcagcccggcaaggctctcctcacctggacggacagcctccctgtcgagctgacaagagctgacggatacacccgccagaggactactaaagatcgggatgctgctaccgccatgtccctggcactcttcagggcaagcctgggtaccaatgtcttctcttactcatggcaaacactgacgtggaaccagcctaaaaattctaacacagccccttctcaattaaatttattgaatgtgtttttggtattcgaagctcatttttatgtttgcaataatgtcagtacaactgatccattattattaaactacagtttttaataaaactccatttcaccataacatctaaaatactgcagctgaacttgattaattataccctagaagaaagtaataacagatttccctatttcaaatacaaaatgggaagctcctgttttattcttctaattatatgagaatgggcaaagtaatataccctccctgtcaacaaatttcagaaacttgcttttatctttttatttttcctccagtcagagtccttgttaatgacaggagcatatcataatttaattagctgacaccaactggcaatctacccacttctttttaattggaatcatttcatagaactatccataaaggcccattttgcataactaataaccttcataaacaagacctttggaaaactgctgactttaatggaaagagataaaacacttggacacaggcaccatgttcccacttcacagaagactagggacacagaatttactctgcaatgtatataacagagctaattcaggaagcacgaatcgggtttcccggatctggatagcaaaaaacttccagaaagtcaacttccccaccgcctcacgaaagcatcctaatagttttgtatagtggaaagaacacaggcttgaaaatctgaatttgtctttcttctttctttagacaaggtctcactgtgttgctcaggctggagtacagtggctattcacacactcaatcatagtaaactatagccttgacctcctgggctcatgggatccttctgctttagcctcctgagttactgagactacacatgcctggctcagatgcaaattttaatctgagctacaatgtgaccttgatcaagttcagaaacttctctgagcttctggttcttatttgcaaaatgaaagcggtataacatctaactcaaaaggctgtcaggaatattagttataatgtatgtagtgtcagcagcgaatagctcaataaatagcttttattctcccaattattacatattaaatttgactaataatactgaattgttgggatcatattagataattttgtgcaagtgcttagacaattaaaaggcaatataggcatctgagcttcactggattaaagacaagttttaaagtgctgttcttacattttacttgttttgattattgattaactgctatatactcaccaaatgttgctgccttcaatgaacctgagatcttaagagcacaggcttggcaatcaggtgaccgagtgtgaactcagcccactttctagctgtgtaacattcagtaagtagcgtaagcctcttaaattgactttccgacctgagaaaagcagctaattaaaaaaacagcattcatctcacagacatcacgaaggttaaatgaaaccatccatgtagactgctaagcataatgcctggcacaaactaagtggtcaatatatgttagtagctattattgaattagtgacaatccaagatcgaatctgatacaaatgaggaagtgagacttagaaaggtcaaagagtcttaccgatattaaggagtagaggaaggaattttattccaggtctgtctgacttcaaaactcatattcaaccctaatgcttttaaagcactcttaaagcaggctcagtcattattttctaatatacagttattgagtattcacaggctgatcgaagtgccaattgttgaggatataatcgcaagaaggtagagggtatccctgccctcagggagcttacctatctgggagaaatagataaagggcaagacaagaaagcatgccatgttctccgataaggaaaatacaccagcctaaaggtgcaccatgcaggaagaacagggaagtgaataaacatgaactttttagaagaatccaggtactaaaacagcttatgaccttttcttaaaactaaaatttctagggatttccagcaacccaggacatttgtatatcaaagaatcaaactacagaactgtaaatggaccaaaaagaagaaaatgcttatggcctgacctcagtagaacacgtacctgcacatgtgagttaacgacaagggtttgggaaagagacctctgtccaaacaaacctccttctccgccaagtgccaacacccatccttccttcagcagttaaagaggagacagtaaacacaattggctttctcagaatggagggtatgcagacccggtgcagggtaaggcataaaagactaacagaagaccgtcctgggggtgagttttgaggaagacagaataaactagaagtgaagcggagtgtggagaaccagtctgggaagcagagactagaaaggaggcaaactgcccaggaatctaataatggggcctacacacccatgctagccagagccacatactccaattcacctagaattggcacaacagcaccaattctgagaggaggaaggggaaggatggcagaagagaagaaagaaagcagcagctgaaaatttcaagaactctccaaactgttcctcccttggtgaaggttgatggtgtcgtccaatcactgcagcaaactgacacaggggcctgcagacggttgtgtgtggcttttggagttagagacaggccgttttcttgttaatcggcaggcaggcgtgacagtgttcggcagaggacaatctgttcgagaataattagattccccctcgcttcttgcgttggtggcggaagcacccggagtatttacaatacaccattttgcttccatccgagtccatatgttcgctggtcaggttaaaactgaggctgcatggcacatttttcactgtaaacaacgctgccccggcaaaccctaggggaagggaggcgatcttgccctcttaatttcccagtccaaggaaaggctcgccttcaggaacggcagcagcttcgatatttattgctggagaaaggccacacctccggggagtcatgtcaggagccataggtccagccaggggagcagccctcatttgatgtgagacaaagaagctagaaaacagcccccatgaagagtatgcctttataacatgttgaaagtcacgtgaatcaggacgtgctcggtggttgtaattccatctattgatggcagctgctgctgcaacagggaggccggctagggctgcacactccatggaggcggtgggagcctcacccattctgggttggggcaggggctccgtgggtgccactgcagccacccaaatcgtggctgcagaccaggcttcctgctctatggagcaggcaggcgccccgccttcctgggtggggctacagctgcccaaactgatgctggagatcggagcttccctgtgctcttggtgggggccgggagcagacaggatctgccctccagggtagagctgcagcctccctgctgcggctgcagacctgggcttcgcgctcaatcgagcaggcaggagccagggacaagagggagccccacctttactgagttggtggagcgtgaactccgcaggtgcagacctggcatctctgcagcctgcaccctggagggcccgggaagacccgccccccacttcatccctgcaggctcgggggtgtctgctcccgcttcccagcccctctcctctccagatgcctgctctgatctccgaccggggttggggccgagcccggggcagcaggaggcagagagattcctgggtggaaggcggcagtccccgtaaggcccctccttcagaccagggagggcctgaaggctgggggccaggatgccagtccgggaccggagtggggacttgtggtgcctcgtctgggtgcacatggaggaccatgggccaatcggcaggaacttcctcccctctgaggtccataaaagcctcaggctcagccagagcagggcacgtggagacaatgggcgaaccagctacagagaggagctgccctctgctgagagcttcagagacctgcagagatgtctgaacggcctgcttgtgaagaggagccaccatctccagggcctcctctctgctgagagctcaacactccactagatgacctgcctacagagaggaactacccacagtgggcttcctctgagctgttctgacactcaataaagctcctcttcatcttcttcaccttccacttctctgagtacctcattcttcctggacacaggacaaaaacgggcaaaggtgccaccagccacagaggtttccggccagaaaagcgacaccccgaagatcacataacactatgatttggaggcaaagaatggaggaaaatggagggaggaagaaaagatggagaaaaatctcttaggcatacatgcctgctgttcaacaaacactgtgctaggcaaggtatacaggccatctccaagaaaagatgactaagtgacttctggaacgaaaagcacaactgccatcctaaccccctccccaacattttccagggatcagccctttacttgttaataagcaagaagacaatgcatctgttgcaactgtgccatcagaggacaccagggcagagttactgcagcacttaattagcttagtgcacttgaaggctcagcctggagttctcaggtgagtggcaggaaaaccctacaactcagggtgggtcccaggacaaatgcagctgatgtcagaaaactatgtttggcaatgcagttagagacaaggagtagacgcctcatttgagaatcatttctcgaaagaaaattctagaaatgtgacagtagctggaggaggatgtggggtcagtagagatgaaaaatatgcaaggcctgatttttaaaatacctctttttgcatttcaattaaatgattaaaaattagcactaaaaagaaccatggagatctatatcaaaacccttcttttctctacgaagaaactgagatgcagaaatgttgagtgactgcttgtctgagacacctagctaatgaagagcagggctcgacttagaatttaggattcctgtccccatcactgggcctctactccatctaccacaatgccatgccatgtttctcactctgctgtgactgatcctcaattttagttttagttttgtctttattaatatgtttcaaaataccctaaagagaaaggtatcagattaactagcagaagtgataattttttttcctttcaaaaggaaaattttaactaccttcaccaacaaagggattaagtctgctctatgatggaactgcattaaaaataatgaggcagataaaaaaaagcttttattattttaatgaattcaaaagccggaagcattattgagatgagcagtgtgttactgccctaatccaatgttaccatgttttaaaaattattctgggtaggaacttttctgctacatcagacaaaaccccaaaatatgccaagtagacagaatattaaattaacatcaaatcctcatccctttcaaaatagagatcacgattctaaggagcatccttgaaagcaccacctataagacacaaaacttgctcatatgcaaagatcacccctctgtctacaatgtaacccaaagattcctctgtctgccatttaacccatgtcctaagaaatttatgattctacacattctttatctgaaacaaccattaacttctatatgtacaagcaagttaatttaatctctctgttcttttgcatccgcagctatagagaaagaaattctgtttttttaacttaccttacagggattgattctatagaagaaaacatcacagtaacatttggcataaacacaaatttgccactttaatgtgatactctcttaagtctcagaagaaaataacagaatcttctttcccaatttcaatgttcacagaaatgttactcaaagaaagtatactataaactataatattccattcttgtgtactatagactataatattccattctctttcaaaacagatcacatttcttggccattaagttgacaccattctgccacattcttgacacatcaagtttagaaattagtactcgggtaactgtgggaacaaaaatgactctggtaaagtgaagttaattacatttaacttattctgaagggttgtattttctaccacagctcacttatacagaccactcccattctgtaatcaggcctagtattacaaaggtatgctgaagcattttttacatctgttggttaaaatgacttattactatactgctaattctgtacatactgtactaatgtttctgtctgcataaagcacaagaatagcctatatggaaaaactgggacccaaaccaaggatttctcctctgcagctatggaggggatgaagcgagtctatttgtctaagaagggaaatgtctggcccagccgtggaagtccaggggttggggggacatggaaaaaggccacagggaaggagacaaaaccagaaaaccctgtccacattaccacagtgacatcccaatggcttactcacttcccctccagagccctgccaaagagccaagaagtcttaaacatcatgccccagcttaccatcctaaaagagatggaggaaggcttgttcagatggctggctccaggttgaaatgatactctagagaagttattactcataaaatattccttggctgggcgcagtggctcacgcctgtaatcccagcactttgggaggtcgaggcgggtggatcacgaggtcaggagttcaagaccagcctggccaagatggtgaaaccctgtctctactaaaaatccaaaaattagccaggcgcggtggcgggcacctgtaatcccagctactcagaaggctgagtcaggagaattgcttgaattcaggggacagaggttgcagtgagccaagaccgtgccactgcactccagcctgggtaacagagtaagactctgtctcaaaaaaaaaaaaaaaaattccttgaggggaaaaaatagccccacagccccctactttcaatatcattttgtccttctacaagcaggatagatggacttcctgttagataatgaatctaactccctttttttttgatatggtacaaaaagtatggggttcatggccaaggtgtttaaaatcctggctctgctacttagtgcaatgaaccaagtaactttaatttctttgaccttcagttttcccatctgtgaaatgaggataacaaacctatgttgaaagactactggaacaaagaaaaaataaaaaactctttgaaaaggacctagcctatagtgtcacattcagcatctactcaataaatatttgtcgatccttcctccacagtcctcactccaccagcagacagattcaaacatcacttgattagatgagcaaataattttctttaactacccaagtatctttaaggcccgtttcaaccccagaagtagattcaataccatacagaggtattttcagagcctagctgtgcattcccaaggattcaggcgtatgtaggcctgtctggcattctactaggcctgctttccagtgaccttcctgtggcaggagccgagatcttctggagaaagtaatgggaagaagcaaatgcttacagacttggtcaaaagaaaatggagaaatagaagaaggaaatttcaagtggacaactccaacccctgagtcagaggtcagcactgtgggatgtgggggccaaaacaacaataaatgaaaaactacttcactgagaacgctgtttctgggagctcaaggaggaactacttcctctggagtctgtgaaacaaaacaagctccctggaagtgaagggttcagcccagtggctgctggagcagaaaacaaacatgaaagtgcctgggtgacaaaataagagaggctcccggcaggcagcccacatccagaggagagaaaaggcagcctgggacacctggcgtctggagagcagggatgacgatgtagagaagtggagggaagagagtgtttgttaacacatcctggggacaagggtgtagtccacagatcagccacaaggacactcagaactgacttggaggagcttgtcattggctatgtgaagaccgagcatggaagtaccatgttgttgctattttcatcctgagcaattataagttggtaaagcaagagttatgtgccttgaaactaatgccacctcagtctagctgctcactcagagcaagtgcagaggaaggcaagggaaccaatattctccatacacttgctatgttttacgcactgagtgaagatttttctcatttaattgcatgtaatttcattctaaagagcagacaaacaatttcattcgattagatatacttcctcaataaaggcttttgaatgaaagcaaatttcattttgctgatcaggctacactacgtgagtgtgtccttatagaaataaattaacctggaattaacattacgtatttttgttgttgttttcaaagacagagtctcatcctgtcacccagatttaacctttctcagccacatctgcaaaatggggatggtaaaaataggtaatgataggagctatttcacactgttttgaggactgtgttactacacagtaaggtgcctggcacaaagtaagcactcaataaatgttagcaatttttatgttttataacactaggctgctaagctttgatggaggaaatcatgcaacaaattctggggagtgtttcctcaacatatctgatgtccaattttctcttgtagctgcatggggcccagaaccgtatcacatggtgcagaagttctctcaaatttccaactgtctactcaagcaccaagcctctgcgtgtgtgcgtctccctcagatgatcttgcttccaaattcacaaagaaaacagaagccacagccctgctaccaacttcctacccaacccccataaacagcattatccttctcctttaaactctccccacttttgagaggaacagtcctcctacacagaccatccattctcctgtgttccacatcctctctgtctcctacagtcataacctggacttccttatcttcagtctcatttacttcccactcatcacttcccctcagcctaaaaccctgctggagatagggaaggagggagggagggagggagagggggagggagggagggaaatatattttatttatattttgattggccgattgcttttcagggtttcactctgtcacccaggctggagtgcagtggtatgatcatagctcactacagccttgaactcctgggttcaacaaatcctcttgccttagcctccccagaagctgcgccaccatgcctggctaattacttttttgttttgttttgtttgttttttaatacagacagggtatcaatatgtttcccaagctggtctcaaactcctagcctcaagcaatcctcctgccttggcctcccaaagcctgggattacaagtgtgagccaccactcctggcctaagtcttctattttaaacaatcccacctttaacctcattcacctctagctacaacactttatttatcccttaatagccaggttgctagaaaaaaaaccctttatacttgctatcatctccatttccccaaatttccaacctctcataatatgtactgtgacatcattaggcactaaatctacccttgctttgggtgggttctaatgacctcttaaatgcaaagtgcagaagactttaatcctttctgcttactgccccatacatgagtcactccctcttctacattactgtggcctcattacactgcaagtttactaaaggcaatccatcaatcaatctggcatagctttggctatatccactcatgtggtattgcacgcagcctacattcactgaacgaatcaatggaaataataagggccttaaaggctccgatggcttcattgtgccatccgctctgcttctatcgctactaactatggaaaaagttaacatttctcttactaagtgaatgatacctttggcaaagtaagatataaaaggtgtaatgttctagctgatcctgctccatacagctccaggtaagtaatctgccccagtgagagatctgtttataccggcaaagtgcttcagggcttaagtcttcagaatttgacccccgctcacggcacagaaggatgcccaggacacactataaagctattagaaattgaaaccaatagccctcctagtttcttttaatagactttcagatgcagtgttttctgctttcctttaaaaacagtagaatagtaattaacatttagtaattttcaaagcagttgtgcaggaagatttcctgaactatgaaagcccacaaatttggcaacaagaagtatcacaacagagaaacagctcttggtttattgttcattgttccccacacttagttaatgtgttacaatgacaatgtatgaaatacatgaagttaccatcaaaacaaacaatgttttttttttgttttgttttttgttttttgttttttttttgagatggagtctcactctgtcgcccaggctggagtgcactggtgcaattttggctcactctaagctccgcctcccgggttcatgtgattctcctgcctcagcttcataagaagctgggactacaggcgcctaccaccacgcctggctaattttttgtatttttagtagagacagggtttcaccgtgttagccaggatggtctcgagctcctgaccttgtgatctgcccgcctcggcctcccaaagtgctgggattacaggcatgagccaccgtgcctggcccaaaacaaacagtatattaaacaagaaaaatgaatttatgaattagctttcttccctcccaaactcccttactctacacaagtcattcctgatggagagattgaaataaaatgagaaatttaataatgaataatagtaatactattactaataattccagcaattatactggtattactttaaaaagaaaaaaatattgcttaatctttagcttttgctccacagcaaattccaattctttcaggacacagccaagagaaagcagataatgttcgtcccttatttccatacgtttcttgtttcaaaatggcaacccaaaaggaatactccactgattgtttgtagatatgctgattaaagaaaaatataaaatttcaagcccatcaaccagtgctgctctataataatcaaaaactacctttacaataaaaggttatcaaaccaaacagtctgatcatcacataatttctcatgaaagctgaaaaggaaatacaatcattcacttattggttcatctttcaccaaacacttattgtactaaatgctggcaatacagaagtgaagatctgcttcatgccctaaagatgctcatagttagcaccaagaactacacatctcgccaggtacaggggctcgtgcctgtaatcccggcactttgggaggccgaggcaggtggatcacttgaggtcaggagttcgagaccagcctggccaatatgggaaaatcccatctctactaaaaataaaaaataaaaaaaaatagcctagtgtggtggcacgcacctgtagtcctggctactcagaggctgaggcaggagaatcgcttgaatctcagaggctgaggttgcaatgagccaagattgtgccactgtactccagcctgggtgacagagcgagactatgtcttcaaaaaaaaaaaaatatatcgacctctaagaatcacatttatcttgagctacagagttcgaaggacagaatttttttttttcaattaatgttaaggtctggaagtttgactttggctcttaacctttggctcacatacctaatttggttactatgtgtttactacatgcaaaaagacttccttgggcctatgaatcatttctagtaaatggagctaataataactttccatcagaaagctctttgtcccatttttgtatcagaaatgggcaagaaaaaagtgaaacaaaataaaacaacaacgtgaagatttttttaaatcctgcccctgggatgttgatgagggcagagacaagcaatttacctgcacacaaaattaagttttttaaataatttagattctaaagaaaggaacttttagaatgacatctgctaatactctaaagcttataactctgagttattgggaaggtaagaacatattttccccataaaaataagttctatatcatggttatgatccaaggtgaactcacagaaacctactttctttggttccttcaataaacattaaaagcctgttatttgtgaggcactatgccaaccattagggatataaaaccaaataggactcagtctctgcccacaggagcttaagagtctagtggaggaaactaaattaacatttgcaagaaatgctgtgtttcctaaaatatctacaaggtgttttggggagcaaagaaaacgggcaccttaatcagactacgaaagggagagtcacagaatgctttcccttaagaggtcatatttgagctgaatttgaaggctgatgaggaattacctacactaaaaaggaaatcacaggtaaaaaggtcgaacaaaccgtatttagtgatttgctgaatcatggaggtgggtgacacaaaggaccctagaatgactcaggtgtctggtttggataaacaatccaacgtaggcaccattcacaaagaaagggatgctaggaggtacgagggcaaagatgaaaaggtcatacgcagaccgcaaagcttaaaccttcgcctcacatctgtttggaacagcagtagctttttacttagcgcttacatcaccaaagccaatgagtagcgaagtctgggacgaggacaagagctgcccttggcatcactgcctgtcacctgtcccttcggggcgccccctgcctccactgcttggcctctgtttgtagcttgtgttttggccttgccagcaagtgtccttcagggaggtctggctactcacagtttatagatgagaacactgaggcagagcgataattaactcgacaagagaaaacaaccagcaaatggccctcttgtcccagagcccacgttcttcaccagaacactgcctagtttaagaaacagcagcaattctgtttcttataaactcatgagcttcccaaagacaggctctcatccggtcaggcatcatgggtggatcatcaagcaaacagatgccaacagacattccctcccaagttattccttttaatcctgtcctttgtcagatgcaaaaggcctaattcaatactggaattcctctatatccattatcaggtcacctggatagcctgtcctaaaagaatgaagtccctccttgccacaacaataagctttgtcttttttcccccccataggtcagcttccttcttttatattctgctacaatctgttgttgtggttaattacacaagagactagcatgggtgtgtcaatccctagtggaactgcgttgagaatctgcaaaccagaccatatattatggggcttccaaattttcaagtgccacagaatcgcaagcttctgatcactgcattaaggatctagacctgtggttcagatgagagatgagcttcataaagaagtatgttgccagtgagaccccactaggttgaagattgcaggaagctgagatgcttaaattattctaattaatgggcttattccccactggttatgcacagcagattgaatggacagttgcaggtgcaaactgagaggtaaacagacctttaaataagtaaagagccagggagcactagctggggaagcacaggtttcagaatgaattattaaagcctgcactgatccacagtcgagggtatgactgatttctaagtgaagacatcttatcctgaatgctgctactttaaggtaaaaatagactcattcttcccctgactctctttctccatcattggtgcaaaatgaaacagctccgttggtttgtaattgatgtatctgacactaaaatttcattctatgtacttccatcctctgaaatgcacagtaagggaagaagatcatcttgacaggtaaaatagtaggttttgacacaaagtcattgagatatatgtgatggagaattttctactgagacaaaatgcagttctatttgaaagtttactacacatttcaactttcactttgaagaaacactttcagataaataaataaatacgcaatgattaaaagaggaaattggctttgtttttttgagaactaccccgtagagtaaagcatacctttttatatttactcttttttataaaactattgattgaaaaatatgaaaaggtagaaggtgcttagaattcctagcacataatacgtgctcaatttattgatgtgaattatatttacacataaatatacagacaaaccagaatatataaatataaagggatataatcactccaacaccatgaattccaccttaattttcctctccttgacaaactactgattaaatgtaaaaagttgctctttaatctagataacacgttttgtatgcatttaagaaacatttactgagcacctgctttacatcagcatagttctcagtacagatagagcaatgaacaagatacaccaggtccttattccaatggagcttaattctacccagcgtgagatatgcagtaccgagaagtaaataaatgagaagatattttcagataatgttcatgatgtggcgacaataaaacagaatacaccacgagcgtgtggaagaagagctactttagagggaatgaccaaggaaggcatctttgaggcagtcacattcaatggagtcctgaagaatgagagcgccaaccattaaaaaaggtttttctaaagtgctggggggaaagcacgtgtaatagccggagttaaattcactgctttcaacagaataccaaataaaatgatttacccacagaaagggtcccttttctcactggattcccacaatgccattagggagccaagctccttatacctttttctttgcccctcctggtgtgtagctcaccgggggctgctctactactgagcagtaactcagccttccagtgatgaagaatggggaaggctgaagggcagggtgtgtctagccagcctagtcagtcccttcctatccgcaaatagtaccttccccagaagccctgcccataagtgttcacttacatctgctctaaactgtcccacagatacagtaaagctaaggaagtttcttgcttttaactggcatgaatgggccttttgtagccccgaaaaaaaaaaaaattgaaactctgttagcaggaagaaagcaagaatgggcactggcctgtgataagccatgtctgctgaagcatcctaggcagggccatggcaagtgcgaagtcccttgtgggataataggtccagcttgtaaaacagaagaccagggtgtaggagtgcagggaacacgacggaagcacagcccaggaagactgtgagtgaaatgggagccaccggtactgagggctcgccaggtcctggagtggggggagtacttttttttttctccacaccacctcccagatgtggtcttgctatgctgcccaggctggtcttcaactactaggcccaagagatcttcctgcctcagcctcctgaggagctgggattacaggagtgcaccactttacctggtgatattacctttattttacaaataatgaagtaaactcagtaggttaagttgactcagctaaattcacagattaggaatgagaggagacacaattataacccagcttgatctgactcctaaattcatgcctgtaacccctgtactctgctgctgtcttcatatccctgctttaacaatatgcctctgagtatgagctgacagaatccattcttccaaatccattccggttattacctactgtcctattcactcacatttataggaagtgtttatttgttctaatattttcatttatttcaaagttctagatagagagaactctatgtctttctttgcctacctaatatgcatagaagaaaaaaatattaaaactgaaaatgactatcttcatctgatgctgaggtttggggtgaaaattcatattagtgggaaagcagatctctatactgctccttctcactctgagatacctggggagggagaaaagacaacactgaaatgtcaaagctcctgccagttcctcggtgctgaaacattaatgagcttctgaatgtgcaaaggtgggcccagagccgaaggatgtttgagagttaaattgctctgcataatcaaggaaaggtaattgagtttcccgaggaatcagagaatcaagaggtctaggagaagtgagaaaggcagggagctatgaaggtggctgctgtctaaccccacatgacgtctctcatgatttccacattaccagcaacactgttcccaaattcctgacacagagctatagcaagctctcacatgggggacagcagtgagtgaggattctgtgggtgactcctgtgggtaagcattggggaaatactttcagatcacatccaggataaaccattattttcaaatctgggaagattaaatagagatggtgaatgtaaaagaacctgtgggacctggcagagcaactctgatattctccagagcagcagcagacagaagctggggctgtttgcttactcctctcgccctgaacattaccaacatgcaggctgggactgtgagacaacgccatcagacaagcgagacgatgccatcagacaagacaggtgttccagcgattgctctaggtaagcctcattctctttgttcactggcagcaccaccccgctccaccctgcgcctcatttgcagagtcctctacaaatgaacatgcagcctgcctggcacacctggcacagctcacctgcatgccgccaagcatgacagactgtctttgctgtggttgtaaaggcctattttcccaagaggcttcttctccggggccctacagctttcagcgtgcacttcaaactcactgaggactgagtgacttacagttttctctgtgtgctaagctgttagattgtttccatctttacacaggctgttccctccatttcaggcatcctctcttccaggctgaacccgttttcatcagattatcttttaccagttcttcagaaagcaattcaggcctcgtttctccaggaagccttctctggcctccacctttgatttcgatggtctccttcatgttccccagcccccgtctatgcctccaccttggtatatcatgctctattgtaattattaatttacttttctttctccgcgaatagatgtacccacagagcctagcagtaaacctgcaacaaagtggtggtttgatcattcttatcaaatgtatggcttaaaagtattgttcttctaaaatgtaaaaagagaatcaaatacaggtctggccaatgacagtatatttcaaatgacaggcaggaacatgtcttcccaagtcctgatttttctttgaatgcacagctctgacttatctggcctctctccagaccttcatatgactcttctctagttaagccaatagcaggcttcaagccaaaaactcctagaagtaggagtttgccaggcaatagtgcatgtgtgttggttgcaagagggtaaaaaaaatattacaaagataacagcctgggtgcaagcttggagagtttcaggaacagaagaggacagcgtggcagagctgtgggttcagtaagtgaggtcaaagcgtgtggacgtgtacctggccggctaagcaacagtagtttcttggtgaatctatcagagaaggactactatacaacataagtcggtgggagcaatgtatctaaagtgagaatgagtgaagtaatgctatcccgcaatgaccactaattgaaatgccaacaactccaagttggctaagtgaaaagagagtcttacctcaattaccctaaaagaacattctagaactaggttaagctaacaggaataagcatatgtggagggtgtttctgggaaaagaagtctgtcagaggcaggcagaagtatcaattggaatgtgtctcagagacaacctaagttgacaccatataaataaatatttctgaagattgcagccaactgatctgaactctactgccacgtaaggcatattaattatttttaaactaatagaattggtgtgcatgttcttgaatcatttaaaattcttatctcctcaagaatctggaatttttgtttgtgttacccctaaatccaaatttcacaatgctgaggagtccatggttttcaggcatcattacaaaataaccagcacttcctaacagctggtggcagcaaaaatctgaaacttatatttctcagttacaatgcctacttaagaatcacctcaaacctttaagtacaatacaatgtgagggttactcagaggtacagagactagtggtatggtcaggatttcaaccgtaccatataacctgcataatgaacaactcagacttacctcacttgttactaaatatttgctttatgtaagggaaaattatcttcagccaaaatggtagagcacaaccaacttaatatatatcctaagtggcttagaggctaagtacataatcccttcagcagtagcctcaactacatttctcttattgtagctagctcttgcacatttaaccaccttcatctgtattgttaacttgaaattttaaatgtgcatattcccagaacgcatcaactaatttttatcattctttcatttgaaaatatccttggaacattaatggttgaagagataaaggataccatgttcctaagagaatttattgtgactcttacactcagtgactggttgtaactgggaaactcaaaaccacaactatatatgactataaaatgacaatgaaaatagtttattctatacttgtaggctgtttgacattttccagcttgccttgattttataaaaagaaatgaccttgaaaataattaagcatatcaaagggtaaggctgtagctcactgaaacacagcaatatgttcacgtctttataacactgctaagcattcatgaaatagcaagagattgtattgctctttaaccaagttctactttaattttataggcttatacatattcactacgaggccattctaatcttcacctacctgcattcttctgaacttgcaaataaaggcaatcaggactctacctgctagacttggaacagatcagattttgcaagaggcatcagggtctggttgattctttttttttccagcctgtgtttaatgagagtgctctcaataaaaacacaaattcagattaggtttctgtactcaatgtttattaatttagatactctttaaaagagcatgtaagcatcttgagaaataaatttagctactgtcactttataaaaggaacaagtgcaattaaaaaagaaacaggaaatcggcaatgatatggaaggaaagtgcttctgagacctggatgctatcagccccactgcatacaactgagtgtgctccctgcagtgttgcaaagggctcagagaaatcacaactggccaaatgttagaaccttccgcagagaaataatgacagaggaaagtcagaatctccaagaatggaagacctaatgctcggagatctgcagacatcttaataaaaggaatattcaggagggaaggtgccattttgacttagttcaagttctctgctgggtttcctcctctacccccaccctagcaagagtcaactcagaccacaaaatttaaattaaaacacaaaatgtttagctggtttctcccaacttgaaaaggggttgacctgggatcccaggtgagagaaaacgagctatataaaaataaggcttcttgggaggccaaggcaggcagattgcctgaggtcaggagttccagaccagactggccaatatggtgaaaccctgtctctactaaaaatacaaaaaaattagctgggcgtggtggcgggtgcctgtcccagctactcaggaggctgaggcaggagaatcacttgaacccgggaggcggaggttgcagtgagctgcgatcatgccactgcactccagcctgggcgacagagcgagactccgtctcaagaaataaataaataaatagataaataaataaataaataagacttctctcatgaggtgatggaatgccttagagatctgctatttccaaaccaccaggaccagccccagtgagccaaatccttaatgcttacatctttcctcttcctacaacacatggacgggggcatgtgagtaaccaaggaagccaggcccaaagagaaacttcctggtgccaggatcattttgggtgagccacttgttttttgctcatactggatacgtgtgccacgtgccaggcacacagtcctgaacaagactgataacgtctctgctctcatggagtttatgttcttgtgatgggtgacaaatggtaataatgaaagattttgggaagagtatcaatcatggaaaacatctatttatcagtccgttcatttacttaacataggctactgttgtgcaacaggtcccatgttggctgctggaagtatacaaaggtaactaaaacacaagctaactttgggagtcagccacacagagacggtgaatgaagctacaggaatcagtaaggtaacccacagacagtgtgcagagaacaaacaaggtggcgaaagaaccccaccgactgggaagacagtagtgcaggaagaaaactaggagagtatggtgtcaccgaagcccagggaaaagcgttcccgaaagggagcggtccacaggacacatgaagttagagtatccggaggattgagcaacatggagattgctgctcatcgcaactacagcagtttcaattgagttaaggacctgaacgccagactacagcggaggtgacaagaagtaagaaagtgaagactaaaaatgtaaataatttcagttgtaattgtgaaaggagagatgattcaaagataagtagaggaagaggtggagcaaaggcattacttctttttttcccctccctcgctttcttccttcctaagaggaagacaggcacatttaaaggctaaaaaaggtgaaaataattgagactagataactagtagagtgaggtccatcaaataataaaagagtgagctctagaaaacaggaaaagacatccttgcctttggggatttcgggacagaaagagggaggtttgctgatgctttcaggggtgaggagaggtgaagggttaaaagtcgtcgaaacaatcttccaccttatagcctcaggccaggaaaactcccaggcaagattgtgtgcagctgaagaggccaccatgtaccagtcacaggtttttaaggtgagcttagatgcaaatggtaaaagtgaataaaggtcggggagtggagaaggtggcttgtctgattattaaagttacttacagatatatatatctgttatatagatatatgaaatttttacaatgagacaataaagtaatatttgggtaagaaaaattcacacatttttaagtaaaaatgtccacttcccactctacattagggtgagaggaggccctggcaatgcagacaatgctgaatcaataatttcagtaacctaagagggctgtctagaagtaaatggatctacatgtgcacatctgaatgggagagatcaggaatgtaggtcaacaagggtcatcctcggtgacccacacccccattacctacaccagacaaactgctttgctgcactgtggactaggttcccctcccttttttaaaaaaaaaagaagaagaaaagcactatctgttttcttgcaactcctcaaggatttagtgcagtgtatgtgtcatgcttctgggcaacttggaaaataacctgagaacatcaaaggtctatactgaacgtgaaaaaccctctgggcacaggctgcaccaggccacacactgccacgttcccttcacagtcctaaagaaaaaaaggtacatgtttgtatagggttctttcagattctctcaccggaatcatttgctccagcatgcatgactgaaacctaccctgattaggaggaggataagatcatgctgcctgagcacacatgtaagtctggtaacaccctactcactgtgtgaaaaagcattttagctgttggcgtcaccaaaatgtaagccctttatttgctgagtgtctgctaaatcaacatacagccttcatattttgtctgttcccctgttaattcttaaaggctgttggttcctggagtctcggctggagtctgggaaccacgtcagtcattgtgcttgtccacacatgtaaagtgctcaagataatgtttgcctatcacagtgtttgtttaacttgctattggcccaataacatgcaaatatgtgctccataaaagctgcaactgactgtaatacctgagagctaggggccgcgggataacttagtcattattgttttttcttgaggtgaaacataaaattaactattttaagaacaattcagtaacattgagtgcattcacaatgataaacgaccaccaacctatccagctccaaaacatttgtatcactacagaggaaaactcgatacccactgaaggcagctgctctcgggtgccccttcccacaagccctagcgaccatcaatctgcactccgtctctatggattcatctactttgaacatttcatacaaacggaatcacagagcatgtggcgtcttgtgtctggctcccttcattaagcataatgtattccgggttcacccgtgctggagcatgtatgggtacttcattcatttgatggctgaatgatactcgattgtatggatagatcacaattggtgtattcattcaactaacaacgagcattttggctgttgctaccttttcactattgtaaatactaatactatttataatatatgtatgtgaaattaagtatcagttttccattcttttgtgtgtgtatatggcagtggaattcctgggtcatacatcaactttttaaggaagtggattccacagtggctaccacactgtacattcctatcagcaatgtacagggttccagtttcttcacatccttactattttccattttactgatcacggccatcctactacatttcattctattacatttaatagtaaatgtgaagtggcacctcattacggtttttttttctttttttttttttttgaagacggagtctcgctctgtggcccaggctggagtgcagtggcatgatctcagctcacggcaacctctgcctcccgggttcaagcgattctcctgcctcgacctcccgagtagctgggattataggcacaccccaccaggcctggctaatttttgtatttttaggagagacagggtttctccacgttggccaggctggtctcaaactcctgacctcaggtgatcttcccaccttggcctcccaaagtgctgggattacaggcgtgagccaccacgcccagcctcattgtggttttgatttgcatttccttaataactgatgatgaggagcatcttttcacgtgcttgtcggccatttgtatatcttctttggagaaaggtctattcaactcctttgctcttttatatttagggttatctgtcctttggtcatttttaagcaaggtactccaatattcttctctatgcatactcctttaaacagacaaaacgcaaaacagtgcggtggttaggaagctgtgctatgaaaccagactgcttgggtctgtcctgcaacttagtcactatgagaccttgacaaaattatctctctgagccaaaatatcttaagagtaaacctcgtggatatgtagtaaatattaaataatcaatgtaatatacatatcatggcatgtgacacatagaaaagctataaaatgtttcaaaagccaataaaagtatgcacaggtagcacgttcatgtaattacttgtgtacttccataaggatgggaaaaatgcacgaacctctcccagattcagccatgtaagggtagaaggaacttcagggaggaagtcacaggttttttgcctccatgttaagacaaaaatggccccataatgaaaagcactgtgcaaaatattaatttttaaatatctttttaacaacataggaaaggcattcttctacttttgcaaaggaggcagaaccaaaatctgtgaagaacctttggctatacagacactccacagggaccaaatctcctgccccatcacacattcctgggaattaaaaagaatggagaacgtttacaagctgctgtactttataattgttatttctttgaaatgattctttttctttgtgagaggaaaataaaccacagtatattgctgagaagtattaagactcattcctttctgcccacacacaaaaattcgttgcacccggaggaatcatgtcaagcagtccacctgcttgggtctaaaagtcatgtatattgttctgacaagtctaccttgctgccaatatgcttttgccgtctttagaaaggagtgtttagtaaaacaaatgatgcctatacagtgtccatgtacaaaggcccctgtgttccagttctatcccatacttgaaaaacaaaggctctttcagggtagggggttcaatatcacctgctatgtactctggtccaattaaatttcccatttgtaatacacaattttatacctataattctttctgtcattttacattgctttaatatgaaaagaagtctctgcttcacttgaattccttagagagcctggcttttctaaaagcttgtgtgtccgtccctacatccctcccacctacaccaaatttaaaccttgacagactaatacattggatagcaatccaggcagtctgcaaaagacagatgccaaggcccaggagtcacgggtaagctcacgtttatcttccacactgcaacgaatagataggatggaagaggtagtcagaaattagtaagccaagatgaaaaacgccaaagttaatttaacaaatatagagaaggaaaattggtcaaagtcagttacagggcaaaagactttctttcaaaaaaaaaaaaaaaaaaaaaaacctctaacaatatatgtgaaaagggcaaagcttaaaaagctggactatctaagaaacaaaataatgttcctggagtagcaaacagaagtcctgtttgctcttcttgggacaaatgctcttgcttgtcccagatcacaggtgaaaaaagatacttccaggcagaataacaatggatagcactgggagtctcaagtttgagttccagctctaaagatacagcaaggccgggtgcggtggctcgggcctgtaatcccagcattcggccaaggcaggcggatcaccttaggtcaggagtttgagaccagcctggccaacacggtgaaaccccatgtctactaaaactacaaaaattagcagggcattgtggcacaagcctataaccccagctacccgagaagctgaggcaggagaatcgcttgaacccaggaggtgaaggttgcagagagccaagattgtgccactgcactccagcctaggcaacagagcaagactctgccaaaaaaaaaaaaaagatacagcaagaaatcttcagtctaaaatgtacctataaactcatttttcacagattatggaaatatttttgattttcaagttttgataacaaaactagaatgtgttacagtttaattctgagtctgcatcgttcttggtttttgatcattatagaaaatacagaaaacacagaataaggaaaaaagagaatgtgacatagtacaacttaagaaaaaataatttgggtgttatttcctcactatcaaaaacaataattaaataatatatttttcattaacctaaaatgaagaatttaacacaatgattttctccccctcctagaaatatgctcaattaaaaatatcagaatagtgtgatatatattatgtatgaaatataatccaactaatactgcagcatggttagtttccatattactaaatatgcctcatggttgcatgtagcttccctttacatttatttataattcatttaaccactcccacactcattacttttttttttttttgctattaaaaaaaagtataattactgctttcaccaaacaaggattgctatgaataattttttcttaattttaatttttctttttttattggcctacttaggaattctactatgagtaatttttgactcgataaatatttctaaatttgcttgtctcaaaatataaatcaatttacacaaaaacggtagtaatacaagactgcctgtcttaaactctccctaagatttgggcattaacatttcttgttcatttttgtcaaatggcatttcactatttacctttcattcttccaaatgaacactaaaaaattacctggaaaactgctttcaagaaacgtagtcgagaaagactgacacgttataatgctcagtcttatcatctacaaacatactatgtctttccaagtaatcttctacatttcttaaagctcgtagacttcttattttcctgcactgtttgtgaccgctaaatactgtattttgcaaaacctttcagtttttttatatgcaaaattcatgttatttttcaaacaaccctctaattttttttaaaccagaagattattttctatggtttcatagtctacaaattactactttcagattatcaatttctgagtatactttgtttctttcagtacatgttatggttctctattctagttttctaagtggttttgatttctactttggtctaatagagtttctgtgctcccacgcattgggtgaggtagaaccaatgctgtctgtgtacaatcaagaattgattttggtaaacgtttcaaagataactgaaaaaaaggtatatttcttttataaaagatatcaagtttatcctatcaattgttttttatcttaaattatttttatatgacattaatataatccctcctttctttgaatttctctgattcacctttgcatatccttttgctttaaatcataacattttagatcattctttttccagagggatgggggtagggagtgccggtgtcatcactggaaaagagcttacacctgagagtactggagtcatgtcttcttaacagagacacctgccaagaaattcattgttaggtgattttgtccttgtgtcaacatcatagacacactaacgcaaacctagatgagacagtctactacacacctgggctacatgatattgcctattgctcctaggctacaaacctgtacagtatgttcttgtactgaatactataggcagttgtaatacaatggtaggtatttatgtatctacacttatctaaacatagaagaggtacaataaaaatacagtataaggttgggcatggtggctcatgcctatgattccaatgctttgggaggccaaggtgggggaattgcttgaggccgggagtttgagaccagactgggcaacatagcaagacctcaactctagaaaaacttaaaaaattaacccagcatgttggcaaacatctgtaatcatagctactcagcaggctgaggcaagagaattgcttgagcccaggagttcgaggctacagtgagccaagatcacatcactgcattccatcctgggtgacagactatgactttatctcatgaaggaaaagaaagttatgaaagataaaaatggtatacctatgtagagcactgaccatgaatggagcttgcaggactacaagttgctctccgtgaatgagcgagtggcaggtgaatgtgaaggcctagaacactcactgtactctactgtagactatccacactgcacgcttaggctacacaggcctagaacactcactgttctctactgtagactttatcaacaccacacacttaggctacacaggcctagaacactcactgttctctactgcagactatccacactgtacgcttaggctacacaggcctagaacactcactgtactctactgtagactttatcaacactgcacacttaggctacacaggcctagaacactcactgtactgtagactttatcaacactacacacttaggctacacaggcctagaacactcactgttctctactgcagactatccacactgtatgcttaggctacacaggcctagaacactcactgttctctactgtagactttatcaacactgcacacttaggctacacaggcctagaacactcactgtactctactgtagactttatcaacactacacacttaggctacacaggcctagaacactcactgtactctactgtagactttatcaacactacacacttaggctacacaggcctagaacactcactgttctctactgcagactatccacactgtacgcttaggctacacaggcctagaacactcactgtactctactgtagactttatcaacactgtacacttaggctacacaggcctagaacactcactgtactctactgtagactttatcaacactacacacttaggctacacaggcctagaacactcactgtactgtactgtagactttatcaacactacacacttatgctacacaggcctagaacactcactgtactctactgtagactttatcaacactgtacgcttaggctacacaggcctagaacactcactgtactctactgtagactttatcaacaccgcacacttaggctacacaggcctagaacactcactgtactctactgtagactttatcaacactacacacttaggctacacaggcctagaacactcactgttctctactgcagactatccacactgtacgcttaggctacacaggcctagaacactcactgtactctactgtagacttcatcaacactacacacttaggctacaccggcctagaacactcactgtactctactgtagactttatcaacactacacacttaggctacacaggcctagaacactcactgtattctactctagactttatcaacgctgtacacttaggctacactacatttattaaaaatctttttctttcttcagtaataaattaagcttagcttactgtaactttttactttataaactttttttaaccttttgactcttgtaataatacttaccttaaaacactaacacattgttcagctgtatgaaaacatttccttttttataaccttattctataagctttgaactatttttaaattttttttactttttaaactttttgttaaaaacgacgacacaaacacacacattagtctatgcctacacagggtcggggtcatgaatagcactgtcttccacctccatatcagatctcactggaaagtattcagggtcaataaaggcatggagctgtcagctcttatgataacaatgccttctctggaatacctcctaaaggaactacctgaggctgtttacagttaattttttaatgctttttttttctgagacagggtcttgctttcctgccctggctgaagtgcagtagcgggatcatagctcacataaacctcaaactcctgggctcaagctatcctcccacctcggcctcctgagtacccaggactacaggtgcgtgtcaccacacctgactattttttatttttatttttgcagacacagggtctcattatgctactcagattggtctcaaactccttatgtcaagcaatccttctacctcaggctcccaaagggctgggactacaggcatgagccactgcatctggccaactttattttttttaataagtagaaggagtgtgctctaaggataaaagtataatatagtaaatatataaacgagcaacacagtcatttcttatcactatcaagtattatatatggcacagaattacatgtgctacactttgatagaactggcagtaccgtagggtttttaataccaggttcaccacaaacacgagtaatgtgttgtctgtggagttatgacaggtggtagaaagttccccgctctattataatattatgggaccagcattgtatacacagtccatccttaaccaaaacatcattatgctgccatgacaacatttgtttggttttcttgtttgttgtttgtttttaagaccaggtctggccctgtcgcccaggttggagtgcagtggcacaattaaagcccactgcagcctctgcctcccaggctcaagaaattctcctacctcagcctcttgagtagctgggactacaggcacatgccaccacgcctgactaatttttgtatttttagtagagatggggtttcactatgttggccaggctggtctcaaactcctgagttcaggtgaccctcccgccttggcctcccaaaatgctggaattacaggtacacaccgctgcatgactacatttgtttcttaacagtggatctattccaggagagtggagtctcaacaattactaattattagttataatatatctgcctttcttcttcacactttcatctggtaagcacctgataaactgaaataacgtttgctctgatcaccagtcgatgaatctctgctgcttttagaaatatctaaaatattacaatactttctaaggtcatgaaaatcttttaggtattaatgagagtgtgggttacatgaatatgcatttatctatactcaaatatcatcaaattatatccttaaatatacacattttatcatttatacaatacacctcaaagttcagaaattattgggggaaaaactaagtatagctcaaggagtaactgcgcctgtgccctatgtagaaaacgcactggtgatacagacaaacattcatttatttacaaaatcgtatttgagtagaaaatattgtgtcatcgtattttgtaacatggtaaatatccctttatattgcaccaaaaattagagtcaggcttcaagatgatttttacataccttattataataaacttagtattatccaactgataggagataaaacaaaaagcaccactgggagaggtttacaattcaggtaaaataaatgctttgttctttgagatctggagtaataactgtctgcttattaaacaaaaaggttattttttcctatgcataacctttacagtacagaagtactccagacttgaaaatccctctaccacctgaggattaaaacactttaaatattcaaatctaacttcttaagtttgaactatactttccatcacagatctggaagtagtctgtgaactatcgaggaagacagggccattcacagggtggtcattcactcaatttggggaaacagagtatcttctaatctgttaggattttgctgaatgacatttgctaggggaaagttttaaacatttattgccgacactccaggaaaatagagggtaatttactggcatgtgtgattgtcaagtgggagaatatgtcaatcacctaattatcattattcattaaggagggctttcaaatacattgtaaatgaaacatgtgtaaagtagccatgaattccaagtatattatactgtgcagacacagaataaaaacttttttcaaaatacataatttacttgaaggagtttcctttcttaaatacattctctatgaaaagcaatttgtactgactcaagttaccacatcttccatggtccttttagaagagatatttattcaaaagcagaaagataatggaaaccaagtgttttactctaagctaatgttacacaaaatcactaagataattttttatttcgttccagtactctcctttccattgagtcctccaggcctcaacccaaaccccctcaccagtaaccacaaaataataattcttttttatctgctacttagtctcagaaacaaactgtggagtcccaaaatcaggtcagctgacaaaattagccttcctcaactacacccataagtaccagtggatccaggccattcctacatccattcaccactgtccggctcttaagaaggactatatttagctcttcagagcccttggcagaaagagataaacattaaaaaacaaaacattattttgaactgaattgataccgtaacaaaaaagtaacatttgactctttaaaacattggaaaacacttacatggtctgaccctcagcaacacgaaaacatattcgaagcaatgagattaatgcttatataggcttttgtttgttttgagacaaggtcttgctgtggcccagactggaatgcagtggcgcaagatcacagctcactgcagccttgacctcccgggctcaggcaactctcctaccacagcctcctgagtagctgggcccacaggtgcgtgccaacatgcctggcaaattactgtattttttgcagagacagggttttgccatgttgtccaggctggtctgaaactcctgagctcaagcaacctgctcacctcggcctcccaaagtgttgggattacagatgtgagccaccacaccagcctatactggccgtttgttaatggcactggtaatattggctcttccccttagacggctcatgaggctagccactcttgaactaaaagaatgcacgtataacatacaaacataatgtctgaatccccaaactatagactttaacccaaattggtgaaacacaaaggaaaaggaaaagaaactttaaattgtttttaggcctgctgtttggatattacaggaaccactgtgatttatatttggcctgagggtataaagatctatgattttatttatggcttggttaaatcttttcaaaacacaagagccacctattcataatattaagaaatcaggtgatttaaaccttactacactctgctaatatactgttctcttcagtagaaacatgtaggagtatgttagggacaatctctcaattatgagcaaatttacaacttcaatgctgtcttcttaaattacatgccatcacttacaatccaaacatcatttaagagtttataagtttaaaaggaggacaaaacaaaaacctttaacaactcattattatttaagccagagttgcaccaagttaccccttcaattgtctaaataaattctagacatggcagcctactgaataaataaaagcaattgataatcccactctatagaaaagcaaaaaagcacaaacataaaatcaagagaccacaccgaagtagcatcatggagaagaataaacattttcaggacagaaaatgtttaagaagaacagcaaaaaagaacaaaggtaggtatattaaatgagcaaggaaggagtggaactgttgaaaggtggggtctaaaaaggctgtgacctgctttctaagtaaagcctagtccaaaaatgtcttgtgaccagatcaatttccattccttctcgaaagatggaagacataagcaaaacacatagagctatgaggacagagtggataatgattagtacatagaaaagttgctacttcgaaggattcagatattaagtagagcaattaaagaatttctccaatgacatcaatctcaaccagacggatgttctcaacatttcgcctagcaactcccccaggccatccttacagcaggcttagggaggtgctactctcttggttcctgctttcaaaaagggtgctgcctccatttagtgatgtttataaaaatggcagtggtttcctatttgaatgttaattattgttatgacacacaaggtaatttaacttgctttggtaatttattcacccttctaattagatgtagttactggaaaatcttccagagtgtagcaacagttccaaaggtgaaatggcaggaggagggagctttcccataggatcgcaactgtaaatctgggatggatgttcaattgccagtcacctgaatgaacaatgccagggatcagagacggtccttctggaatcaagcaggtggcacccatcaccttcaagaatttgatgattcaagaggaaggtaaagccccaaaagatggttggagctactctgaaaagattaaagactgaacttgaatgaaccaaggaacaataccacacaacaccattttaaatctcctagaccgggagtcatttacatacagttgagaaatgccgtagacagagtataagccaaaaacaccactgaagtgggagaggctccactcgagttacttgctttgtggaagtattttcacgcttgccacatcatacctgctcgatcaatatttactgaaacaagcaaatgaatgaatggacaagtgcatgcatggctacagcataaaaacaggcacacccactccatctctctcattacggcctcctcagcaagcagaccttttttcttaatttgaaggtccccaaagtgagcgagtttcaatcaacagaaatttctttgtctttaattaaactgagctgccactgcttcttctgtgaggtctaagtgccagcctgtagccatgttctacgctagccagaagggaaagactgaatcatatttgtgaccaaaaaaaaaaacccattagactccaatcaatgcagagcaggtggctgatgactgcagcgatccctatgaggagcacggattgatactgccaaatgaacacattaactgaaactacccaggccttaggggaatggccagaggcccctgtagggaacagtttaagtcaaacttttcctgcttccattgtaggatggaggattcaagggctcagattatataaacaagttcaaggccatgcaagaatgtatacagaaatactcaaacctctaaccccaacaggaagaggaagaggaggaggaggagaagtagccagcagaacaagtggaagaaacagcttccagtgaggtcactgcacccaaagaagaggagcagtcaagctaacgaaagccacatggcactgggctccagtccttccacttcagagtgatatggaccttcgcaaaaggcctttcaattgccctccaagaaagcgtctttccctctgttgtcctcttcactgtaatgcacaaaataatttattttggtgatgaggggtcctgatctcttgacatacagactgaaaaaatgggggttgtatgtgtgtcctacatataaatctgtcagcaaatattgccaccactgaattctattttctcagattgccctcaattttgccactctgaaataatgtgctgaataatctcagcaaccagaaatcatcatccaggaatgtttcttatgagacagctgatttattcggattcactagatcccttttagtagatttaatccccctttgggaaatgtaatagcaagaaaaacatcttttaaaagtgctggagtgaggccacttctcctagaagaagccagatggtcagatatatatttctcaaaacccatcttaaccttgagtatatgaagggatactacatttcattcctgataaattttggtttccatgttggcattgagctccaggctttctatgtgttgatagcggagatttggaccctccatccacagtctctttctaagtgaaggggaagattggtttttgctgttccttgttattccaaaagctctggtctggggcccatgttcaccctggctctcagtctggtcagatgcaatgttcttcaaaggtggggacctacttgttatcagagtagcagccaaaagaggaaaaggtgtgaattaagtactcagttaaaaggaaacatgagaccaggtgtggtggctcatgccaataaccccagcactttgggaggtcaaggcaggaggatcacttgagccacagagttcaagaccaccctgggcaatatagcaagatcccatatctaatatatctaatatagatatattagaaaatatatatctacatatagtagaaaaatatatatacacatatattagaaaatatatatacatatatgtatattagaaaacataatctctctctatatatatgtgtatatataaactacttatatatatataagtatatatataaactacttatatatataagtatatatataaactacttatatatatataagtatatatataaactacctattctatcttataccttccactcaaggtcatgaagatttgattttggagactgatgcaaatgtttgccacctgattttaaaactcaggagggttaggccgggtgtggtggttcatgcctgtaatcccagcactttaggaggccgaggcaggtggatcatgaagtcaggagatcaagaccatcctggttaacatggtgaaactccatctctactaaaaatacaaaaaaagttagctgggagtggtggtggatgcctgtagtcccagctacttgagaggctaacgcaggagaacagcttgaacctgggaggcagtgcttgcagtgagctgagatcgcaccaccacactccaagcctgggcaacagagcaagactctgtctcaaaaaaaaaaaaaaaaaaaaaaaaaaaaaaaaaaaaaacaactcaggagggcagaagagaatgggtaatcactatacctagtttccagcaagagattcctccctttagaaacactccccagaactgacagaaacagagaaagaggcgtaaggagccataaagagatgtgacgtgctttaaaagcaacaaaatatcagggaggaacatactctactctaatatgtccatcataggggttctatttgtttcctacagataaagtgatcatttaactatgaaaattactatcattcatctctccacatgcattcccatccttgagaagtggtaggaaccatgcgcctctgggatgtggaaacaagtgctcttgtgaacagaggtttcattccactgagagaaatggccatgcaaagcagtgtctcaagagagcaaggcaaatcaatgtctcgcctagagtatattttacaaatttctaatacaaatgattgcactgaaggacaaaggttttcctgtactcttcctccatccaaccttcaaacagatacactagtctcagctctagtggaagtaggaggcatccttgacattatactcagctgtgatgtaaggaatctgtgtacttacaaaactaatgcaaagcatttcaggctgtcagctgacatccctgccactccccacagctgagactattcagtaatggcagtacatctgacatcctgtctgacatctagaggactcaggaaattcaaagaaaatactataaattctatcatttcatgattcacacttcatgcaaccaaagatctcctctacacaaaaacacaggaaatgtcagaataccccataggtatgtgatttttcttaacttgtatggttttatttataagaaataaattcagttactgaattatgaaacagacacataggggtcccctttgggatctagtccttaagatgcgttcaagaggatgaaggatgtccatctctgagatatattagtacttctacaacccgtgtgccaagcaccagtgggctaacatatcctccagatacatagacacaacttaaagcagagaagccaggtagagagatttgaaaaatgaattctaacactagcatactaaattcccaaataaattgtttaattacattgtacctacatttccccaatgatcacgtagagataattacctttgcttatttcacagggggcatttgtaataataaaaagaattatttgaaatcttcaaagaaagagcactattttaacctacttatataaggaacagaaagagaaaattgagttaacagtcttaaattctgccaaattaatctaatttttaaaaagagagaccaagtaaaacctcaccactgttgttctcatcgtaactgaaatccagcacattaaagagagagagaaagagatcaacttttaaaacttgtaaaactccatccctggtggccacaaacactcttatcagttccccactgaaaacccctcctcgccatctcccttccttcccctttctcctattacctcagccttcactccacttaatcttcccatctctcgacttctctatcacctcttcctccctgatagttatgacctcactcccactgtcacacatagaactgatccaaaggggacctaagaattattctaaccaatctcccacacagtaaaaaggacaactggagactgaagtgataacgtcacaggctcagggtcaggtagccactttcatgcaaagctgggtcctcacctagatatatgactcccagtacagtactctttccagtaccccacacaacagtctacctggacctgttcaccagccttatccaagagatccatttctgaaacagttaggtgcactttgttgttcttccaccatataaagcactttgagtcacaattagaaaaataaaactgatgacagcaatcagattagaatcctgtatctggaagacacctttacccataatccatcttatccaggaagtaagactcaggaggccatttccacaatgcctctcctccccagacactcattcctatgttcaacatcacttccattgctcaaacctaaatccttcctaatgatgatactgaagcaaaatcacaataccaggttttccagacccggctgagaagacactaactgagcccctaagtacaaatgagcatacttaacatagagaagacacagttagcacattgctaaatttctccacacccttatttttagcagattaaataattgtaacccctttaactttatcttctaagtctatttttggcttttatctaaggcccctttaaattctccatgttgcttttggaaagctagagtccagaaccaaggacaggtagctaaagtgtttcacataagagaaactccatcaacaaaagtattgcgaagtctgtacaagcccagggcaatcaatgaaatctgcatgtaaacgaggcagttttccagacaatacttttcaattagactaacttacaaacttgaggaataacgagaaactacaaagaaaacatcaactgcgtcttcaaagcattttcaagcacaaaccctaatacagtttactggatgccatttaattgggcagctctaagcatgtagctaaatacaagaaggttggcataagagataaaaaagcaaacaatgtccaagctacatcacttaaatactgtcagaacaaggttaagaagaagcaaggtgagaaatcagggaaaatgcaaataagaattccatttcctacaagataaagaaagataaataaaaatcctgactagctaggggagtatgtccagcaccaaaaaaaaaaagtaattatttcatgtgtggtcctgatataaagtcttgaaaataataaggctgctaaattgcaaatatcagggaagtgaagtagtagctcaaaagattatgaaaattgagatttccaaactgaatttgaaaaggaaacaggtaaaatgaggtcaggacattacagatgagaaagaagcttctactatttggctggctgttttaaattaataacctggaacattagcaggtttaaagtcctataaaaatgacacggagggagaagtaaatgcggtagaaacagcagtgtttacaccttcatcatagaaaggtattactaaaaggatttacaaggtggtaacaggatacatatcaaagtcaaagcgctttaataaatgatgagaaaagacattaggcatggaagtaaagccgaagggcttgaaataactccacctatccacgtcccagattattttaaaccaagtaagccactccaagatccacaaaagatcaggttgtatttttccctaagtggcagtattcccatgagcaccaaagcagtaaaggcagtaggtagaaaaaccaggagttaaaagaatataaaacactagtcctttctgggatattgttacacatgctgaaagaatctaaatatatatatcatgacccaaagaggtctcaggcttaaaatccaaaaagaaagaaaagcaagtatattgcccttttttcctattgggaaaaccttgtaaccactgaaaaattagaacagataaataggaatgggtcagtataattagtatcttctaattatagaagcacccagattggcatcaaactcaccaactcttggctgtcttcaacaatgaccaggcctcctctggggagactacttcttgccatcctcaatctgtacctcagatgtgtgacttcttgcttctaacaatatcacagattatggactaaatgtttgtgtcctcccaaaattcttacgttgcagccctaaccctctgattctatttggagaaggggcttctcagacagtaattaaggttaaatgaggtcatacaggtggggacctgacacaataggattagtgtcctcacaggtagagaccagagagctcattgacctgctcccttcctccctgtgtgcttgcatgaggaagggccatgtgaggacttagcaaggaggcaccatctgcaagccaggaagagagacctcaccagaaacctagtgggccagaaccttgtcttaggcttctagtgttgagaactgtgaggaattataaatttctgttttttaagccacccagtctgtggagttttgttacagtaccctgaggtggctcagacatacctaccacattgatgcttaatagtgactacccaaacagcaggaataaaagtttcaatttgtttcttacatttcctaatgcaatgctctgtaaggctagatgttttagaaatgctttttgaacttaataatggttttaaaaagtcacagacttcaataacagccatcattttctataagcactaatggtgttatatgccaagaatttttaaaggcaaataaatttttcttcttatctaaaaagctgcctggagaatgctcacccttcctttactcactactgaaaactgtcaatagcaattcaagtaatataattccttttttttggaggcagagtcttgctctatcccccaggctggagtgcagtggcgcgatctcggctactgcaacctccgcctcccgggttcaagcgattctcctgcctcattctcctgagtagctgggactgcaggtgcccgccaacacgcccggctaatttttgtacttttagtagagacagggttttgccatgttagtgattctttttttttttttttttttttttgagacggagttttgctctgtcgcccaggctggagtgtggagtgcagtggcgcgatctcggctcactgcaagctccgcctcccgggttcaagccattctcctgcctcagcctcacgagtagctgaaactacaggcgcccgccaccacgcccggctaattttttgtatgtttagtagacatggggtttcaccatgttagccaggatggtctcgatctcctgatttcgtgatcacccgcctcggcctcccaaagtgctgggattacaggcatgagccaccgtgcctggctggtaattccttttcaagaattacaaacaccaaagtatcttgtacaatggtaatttatgtgcacacgtatgctaaaaatgccaaaaagaacttacacaatttttacatacataacatactttagttccttgattctatgccaattcacctaaatattaacaaacttaggacagtggaccttgggcttacagaatattaaattgtagaataacagaatcataaaatcatagaatcacagactagaggtttgtctcggtcaaatctcaccattttttttaaatgaggaaaaccagagctcagtaccttgctcaaagtaacataaatagttcccttaattcccagaattgtggttttttactgtattgttaagaaataattttctgtaaagcaaaataatgattctcaaaattaataaaacacatataaaagatttaactcactagaaaatgagtaagatgctaagtctgatttttaaaagaattcaaagaagacacaaatacataagcatcagaaatgccagcaagatgtaaaatgtgcaaaactagtcaatatgcataggaaaataatctattgcattctccaaacacaactgcattttatggacaagaaccaggcgctttactgtctattttctgcagcacacacaattctagtacagctcaaagacagtgaaaggcagagctgacctgatggttgagtagacaaaacatgctcttttttttttaatcatttcaaagtctttcctcacagtcccttaccatgcacaagtactctgaaaccagagaacagcacggtgggtgaattcaaaaaacagaatttagaattcttgtttaattgctaactttctgaaagccctcagaaaaagacccaagttcatttcatatcagccccaaaactaagagacaatgaaaacttgacctgtgagagtctggcactgtcaatgtccacagcacttctctcaaaatgatccctctgaatacttacaataatcccaccagggcaaaaggttcacaacagcagttcctcagccaagtcgtgggaaaggctgtatcacattccggtcttctgcttcccagtctcacactctccccacatcacaggcacagttacctcgcaggagaatgtctctgaagccccttagagtcattatgcaagaggtctcacggaacaacttttcgctgtgactgaagagatgaaatgtaaaatgaggaaacacgaaagaagaaatggtctgctacacaaacatacaaagtaggtgtgatgtgctagataacgaggtgatgtgctgatggagctcaactctgaccccagttccacagctccagtcaaaagatctgcgtttaagaaaggagaaacaaggtggctcatgcctgtaatcccagcactttggtgcggtggcgcacgcctatattcccagctactcgggaggctgaggcaggagaatggtgtgaacccggaggcagagcctgcattgagcagagatcgtgccactgcactccagcctaggcaacagagtgagactctgtctcaaaaaaaaaaaaaagaaaagaaaagaaaggagaaacaaataggaatgaagagtggaaaagatatcaaataaggacccaaaagcactctgagaaaacaataaggttcttatgtcctgtgttcaggcaaagaaacacaagacatagacatgaagagaacagaaagcaaggaataatgtttaaaactaatttggcacaattttttttcttttaaaatgctcaagaggatcattgcagaaaacacagtggtaaagcaagctgctgagggatttttcaatagctccactgtgaaaaaacaagcacatcttaaaactacaagctttgaaacttttaaatttcttaattaaaatatttctagattccgttcatttctaagcaagactgcagccctaaagagaccagtaaatttttattcatcttttttgaaacaaacatgattaacaagtcattgtttgaatagaaaactatgaattaaacaaacaagcaaacaaccccacaataatggaacccattccttggagataatgacaatgcaaagtacaagaaacccattttgaagcattagtttcatgtgagcacttgttgacggaaatattacaagaagtccccctaagaacagttctcttcattgtcgtatcaatggtcttggtggctcacattcctcacgtgcactgagggccgtcttgataaaaagtatctagtagacctcttggtgtcaagttgtaaagctcgaacttgttttgggatttttaagaatgtataataaatatcgatttattaatttacaataaaaaaactaatgggtgaaaggactggacactcagcctctgaccttcatgttttctccctgcataggaagtcaaactactatcagaatgttgtcgtgtctggcactacagcaagagcaatgagttgcacaaaccatgaagcaaacagactgttcattcatccagcacgtcctggcctagagctagaaatacagcagcgaacaggagcgatcagagtccagattggactctgaaaagaggatctccttgccccaggagctgtgcagtatggccccagttctagctttctctggcctagacaatgcctaatggagccctgcaaagattcacttcactgacttttttaaaaatatttttatataacataaaattttcactttaaccattttaagtgtacacttcaatggcattaaattcaaaatgttgtgtaaccatgaccactatttccaaaagatttttgtcatcccaaacagaaactctgaacaagtttgctttttaaaagtggcacaagttactaacatttgtggttgacatttttttttttaatatctatgttaagaactcgattataggcctacccataatatgcttctttaagaggtctggggccaggcgtggtggctcatgcctgtaatcccaacactttggggggccaaagtgggtggattgcttgaactcaggagtttgagatcagcctgggcaacatggtgagaccctatcgctactaaaaacacaaaaaagagccaggcatggtggtgcacatttgtggtcccagctactcgggaggctagtgaggaggatcactggagcctgcagggcaaaagctgcaatgagccaagatcgcaccactgcactccagcctgcgtgacagagcaagaccctgtctcaaaaaaaaaaaaaaaggtctgtatgtttcattagccattgtgtgtgtttatgttaaaaatatgaagtgtttcacaaatttgcatgtcacccttgtacaggagccatactaatcttctctgtctcattctaattttttagtatatgtgctgctgaagcacgaactagccattgggttttgattttataactgttttccagaaggcaaacttctaacttcttaaagagaaaggtaccttgttgccatgtcctccctcccaccccactacacagaggcgctttcttctacaatgcacactatttcatccaactcttacaaatatctaaagagatgctatcatcagctttttagacataaggaagctgagactcacaggaatgatatttctcaaagctactcaggaagcaagggaacaacgcaagtgtcggtaacagttattccatattggagcatgactgactggatgaatatatgtttgtttttgctatacagctaacattaactggttctaagactgaatactgtattaaatttgttattaaaatacatactcctataacaagaagggacatataagacaaaataggaaagatgaaaaggttttaaagacacaggagaggctaaagaagtgatttttaatggatatactctgggagaaattctcaactatttccctacaaatgggtgacattagtcacttagggtggctgccttttttctgaaagctatcagacatctccatgggcaaaataaagaaagagaccccctacggtttatttatgtacgtatcatggtagcactccgtggttttaagacatattgaaactccatcatatgctgcttttaaagcccaaataactaaaataaaaactcccaggcacagcaacggcaaaatactgtcatttgtatgtgcttaggagacacgtgtctctaaaagcaacatgtacatttctcttttcaagcaaatgtttaaagaactggcaccgtaacaaacaaggggaaatatggagatcagttttaaaggcaggatttgtttttgtggagtctaatttatttcaagaaatccagattattaaattcacctcctatctgaggaaggatctcaaaggaaaggtaatacaggctagtcgtccttaaatgcccaagtccaaaagactagtatttaagacccaagtttatcacttactaagtgtcagaccttggccatgttacataatcgctctcaatctgtttcctcaaaataatactgcttaacaaaggattaagtaaaatggtgcgtataaagcaccacacacagaccgtagcgtatacttaagagttttatttcagcattagaaagcatgggaggccgggcgcggtggctcacgcctgtaatcccaacactctgggaggccaaggagggtggatcacaaggtcaggagttcgagaccagtctggccaatatggtgaaaccccgtctctactaagaatacaaaaattagccaggcgtggtggcaggcacctgtagtcccagctactcgggaggctgaggcaggagaatcgcttgaacccgggaggcagaggttgcagtgggccaagatcgtgccattgcactccaacctaggtgacagagtaagactctgtctcaaaaaaaaaaaaaaaaaaaaaaaaggaagcatgggaagtaggggagtcgctaaagctcactgatttaaattactactcaattagactaaattttttaaaaatcatgattttctttgtccccctccccaactcacacacaaaaagccaacactatactaaataatagaagatagtcgaggtcaagattttcaccttgttctccagctatcattttttccctcccgacttctattttggattaaggtatttcaggggccccaacatcaaagtagaacagaagaaggaaagcaagagaaaatgagaggtaggaactagaaaagccagtatcagaaaagcatacagcacttcctcactatactagcaaagcttaccatgcaatattcaacaggtaaatcctgatggatggctgacaccgggttcaagacactagtccacatgctccacatactgaataccctaaggtagttcagagagaaactgaggggaagacggagaaaacgcacctcacggtgcattctgtatgtcactgccttacacgcaggagtttcaatgttttggtaccaattaaagaccaactatcagttctccatggaagcagcaaaatataaaagtatccttgaaatcagtacagggcccttctgcgagggtctggtgatgtggttttgagattctttgttttggatcattcctcgtttggtggacccacaaataatggtcctgcctagaaccatcaccgcaagctagagtgaaaaaatgccagaagactaggctggtgggtaaaaaaattcaacgtttttcctcatgattaaccttgggtggccttgacaagttatgtaaggttttgtttcttcagaaagacactgcatttttagaacatctctaggcacaaaaattagtcatgtaactgaaagacaagaaaattttaagcatatattataaataaatgtgaatattaggggtgtgtatccaaacacatgaatagctcttaaaagaataagacaaaaagatcaaacatatttgaaatcagagagatgtcttttgggaactgaactcttgccatgagcaggagaaaaccagaaaggtcttcatgggttctggtacctgttcaaccattaattcatgatgtgtcgctggaaaaagatcacaaatgtcttcaagcttcattttccctatctgtatctgcccaagatctcactggattctcgaagaatcaaatatgataacacagtcattcctgaagtatggccacggaccaacagcatcagtaagtcaggaacttgttcaaatgcagttgagtcccacccagtcctaataaatgagaaacttcagcaatcggttattctgatgcaccttgaagtttgagaaccactgcacaaaaacagatacaatctgaaacatctgaaaacactggagtgttgttattacggaaaaaattaagaatcatacattgaagatcttaagaactttcacttaaaagttggatacagaagaggctatgtgtggcttttgttgttgtttttgttgctgttgttgaaacaaggtgtcactctgtcacccaggctggagtgcagtggtattattatagctcactgtagccttgaatacctgagctcaagcgatcctccttcctcagcctcccaagcagctggaaccacaggcatgtgccatcatgctcagctattttttattttatttacttatttacttttttaatttataagaaaagaggtttaattgaagaaattggcaaaaagaaaggggctacagaactcctgcaactttggaacccagcagggcagttgttaaatgttaaagctccaaaataacctggctcatttttaatttttcttttgtagtgatgaagtcttgctgtgttgcccaggctggtgtcgaactcctgggccgaagcgatcctcctacctcagcctcccaaagtgctggaattacaggcgtgagccactgtgcctaacctatgtgtggcttttttaaagccaagattcgcagttaatgtaaatgctacaataaaataaaatccaaaattacggtacctatcaatgttaaaatgcagtattatttccttataactttaaaagggttaagggaaaagaaataaaattagtaatgattgtaatgattacatattctttaaagagtaaatatgagactaaatgtatctcaatccaactattaataaaaaaagagtgaacttgagattagctctctctagggaaaaaggagaacagtaagtcctcctgggatctttacattttcttggcaagagtaatgcattcattgcttttaaaaaggtaaaaggtaaagtcaaaaaaaaaaaagaaatgtagttacaaaagatgcatttcaattgataatgaaggcttttaatgtaatgattataggaaatcttggaggagttctaataagtacagccaaattaagaacaaaatatgctaagaaaacagagaagtcatattgtttttcattctacattctagttaaacccaataaaacatgtgaagacaaaagtattcctcattagaagtatccttaggtcccatttatcgtcatatcttgtttactaccagttaagaaaatatggtactacagcctctgacaaattagggacaacctgagagccacattggtagaaacatacagatctgaaaaaattctgggatgaaagtaaggaagaagagattggaagaataaattaacatttaaaatacaacaagatcacatagaaatagaaatagttcgatgaaaagacttgtccataaaaagcaaaattaccaactatctggagatttaaattagactgtactgatgaatgtattcttcagaatatgtttatttgtatgatcttttacgtacccttcaataaaactctagactaagtccctacgacaaaagaggcagccccagcagtggccttgtggcctgatctacagagacagcaagccgccattcactgacccacccccatcacactggcaccccacgtttctctccaagcttcttccccacagtataaatcagatccaaattagctgctagtcataatcagcagaaaggatggagaggccttacagttaccttagacacagccctagtggtcttctcctacttcctcagggacggcctccgccagcagcacaacagcacacttcctgtagatctacaatcagttcttccgagccgcagacggctgctatcgtcctcgcagctctccgggtactcacgcttctttttctccctctttaattctaggccttcttttctttcttacctttgtgtcccctttcaagctttcccttttattcaaacgtacaccaaaatggcaaaagcagcaaagcattctaaatcatgttcacgcaagccagtgctggggaacaaaatggatacaaattggtcattatgttctctttcatttgggggtggcgcacaattaagagaggtacgctgtttttatgtacttctctataactgcagctctaaaggttcctcataccatcatgaaatttaagaggtacatgagcaatggcactatactgggaaagttaaaacaaaagatttattaacctgtgggttgttgttttaaaaaagtatcaagggggtctacacacttcctaaggggaaaagtaaacatttttttgaacacttcatatactacagttcttgtggggtttttttgtttttttttttttgacatggaggctcgcccagtcacccaggctggagtgcagtagtgcgatctcagctcaccacaacctcccacctcctgggttcaagcggttctcctgcctcagcctcccgagtagctgggactacgggcatgtgccatcatgcccggctaatttttgtatctttagtagagacagggtttcactatatcggccaggctggtctcgaactcccgacctcgtgttccgcctgcttaggcctccgaaagtgctgggattacaggcgtcagccactgcacccggctgcatgccacagtttttcacagacattatctcacgagtagacatgccaaacctagccatctagagctgtgctatccaaaaggtagtcactaaccacatgtagctatttaaatttaaaacatcattaaaattaaatttgaaattcaattcctcagtcacattcaacgcatttcaagtgtttgatacatgaaaacggctactgattgccatattgcacaacaaagagagaacatttccattatcagagaaattctacggcacaacaatgatctaagtctccttcacgaagattttccacaaaaacgtctgaagaattacattgggtccctcgtacaatgaagattaattcgctcacactaaagctgtaactacaatccatatacgtgtgttctcttgtacctgcagccaggttttcaccactgccagtttctacgctatacttggcctactgagagctccagtcttttacaaacacttactacatcctaacctctcttgaatgtctggcaaaggtttggatcaaaaaagacatcacatttttgcacatatgacataatacttgtagttgcctggaaatttattggcccatatgaagtgggatccccggggcagtgacaaaactaagtttatgctactgaggttttgcttgcccaggaaatataaaaaacttgtgactgtgaagtcactaaataaactaatggttttaataatgagggcaaaaaattattttaataggtataatgtcattatcaaaccacagaaaatgctatacctgaaatagagttcaattttggttagatttcctttaaagtctcacaggactcatgtggtacggggcctctgtgacaataggtaacttttcataaatgcttaagcacatctggactctactccagtgacctacaaggtaatacatcattctgtcagtttcagaggtacattcacatcctattctccaaaaccagaaatcgcccagggattcctagaccatatgacatgttgctgaaggaatatacaaatatatacacacaaatgtgcgtgcacgcgcgcacacacacacacacacacgcactgaaagaatattataaccattcacctttcttctaaattttaccttctgtgttaactttccctgtgttgacaaagaatgcctctcactaagtcatgaccctgcaggtcactgtaatacaacatcgcatacctggattattataatgggtgaagggttcttacatatagctcaaccggaggttaggaagccctacgaacactcagatttttgcttcatttttaaccaaaaggggtcagagcctttgtcaataccagctgttgcagtggttggctgcctgtgataataggctgcctttcacctgaaagaatgaaggggtgtttctcagagtaatatcttacgatacagaggatgatactgtctttaaagctagtgaaaatcaattttactgtcacttctttatttaaaaaaaaacctccctttgcagaaatatcactgagatgtcatgtttaaattttttttctacttcacattatttataagccaatattttaaagatttttggcagttctttaggcctgggcaggggtgatatttgcccagaatacatctgatatggtctcctggttgtttctaaatttcctgttttgactgatcaatgcttgtacagtgcttgttattaactactagacaataactcctgggtacagacactgctccttgtcttttttcctttgtgtaattcagatagtaaatgtccagcaaaaagcaagattccaaggggtaaattcaattgctgacgtatttgcatttctaattctaatccaagttaaataaatgaaaaatccactgtaaaagagaagcacaaaaggcaaaatcttcacaatcattacccagggaatcactgctttgtataaaatcattaaaaattatcttgaaaaataataaaagcaagttgactgagacaattatacaattctaagaaatgtttttagaaatgttcttctaagtattgttctttttaaattttatttttggcaattctcaactgtaactacaatacaacattctttccccaatgaaaaacaaattttaaactatttatttaacacttttggccaccaacatttacagaaatagttgcttagtatagcagctcaagcagcttaaaaaatttaaaagttaaaactttcatagggcctagaagcaaagaaaactcattagcaataaacataaatagtgcccaatcttgttttctaaaactattctccaatttctaaattctccaatttctaaaactattctccaataaaagaaaacagggcacattgaagaaatggctgcttctaggatatgagcaggaaacataaaaaataagcctgaagcatcttgtagtgccagaaagtgaggaggtgctaaagaaaaaaaaaaacaactctgcaatgatgaggatatgtcaaacggacacagaaatcaactgaaaaagttccctgcggccaaaagttagaatattttgggcaagaacataaagtagtattggattataactagagatataaaataaattgtgtacgaatacatactgatataaataaaagacaaatctcctgttcagaggaattccaaataatttacatattaaatactcctccttcaaggaggtggaacgtggctcccctctccttaggtctgggtggtgcctagtgacgtccctgtgacgaggacagtgtggaagggaaaaggaggagctctgcagtggcgaaggctgacaaacgcgacctcagctaggtgatcaaggtcaaaatcaacaagtcaagtcaatagagcatattccaggtaggatgtaatgaaaacggcactttatctctgtggtcttcctccccaaaatccgtaactccactctaatcatgaaaaaaaattcagacaggtattaccttctttccacgtaaggtacgttctacaaaatacctgaccaataatattcctccaaactgtcaaggatcatcaaaaacaaagaaagtatgaaaaactgtaccaagagaagcctaaagcaacacaaggaccaaaaataacgtggtatcctgtgtggcatactggtacagacactgggtaaaatccaagggaatctgaataaagtatggactttagttagtaccagtatatcaatattggttcattaattgtaataatgcaccatactaatataaggtgtcaatagggaaaactgggtacagaatatataggggaacactctgtactattcacaattttgctgtatatctacactttctaaaatttaaagtctatttaaaaaatttaaacagtctttccaatactaaatcatactgcatacaattaaaaatatttatttgtttgccattgtaattgtggttaagagtgtgggctaggataaaactgctggatctgaatcccgttcccctgtctaagttgatttttactattaatagttatgtgcttgacctgtacacagtatatagctaacacgggcccattctgacatcagttatgttcagcagtctttgctttcccagtaagagaaaagaagacaaataaggcccaatcagcccaaagcttctcatcacagggtagccatatttagtaaagaaccaggcaacatttgctgagtatcacagggactaaacctggggcaaactggacccccattcacagtcaaggcaggttctctttcccaagaacagatgtaaccagcaatgtgaataatgcctctgggcaaagtgcaggactgattttaagagctgtcagcaatttcacatgatatgaactctgtttatttctaatattcaaatgagctcaactaatgaaatactattttattttcataagcaaaaagagcagtaaaatgaatttgataaaaaatatctgaagacacattcaataagaatgaccggggtacatagtatgttattcatcttttttaaagtctacatgttaaaagatttacaaccaatgaatgcttcttaaatgaatattcatacagcaattgcagtggcttttttactgcctaagagagtcattaaaggcttgtcatcctggcccagcaatgcctctggtgcttctaaatcattagatcttagtctactgctttgaatgttgtaattgcaacataaaaatgagaaataaattaccagtatgaacaatcaaaggtcacgattttcagcaaaagcttagaattttatagtggcacctactttttaatataaacgattaagggtatttttcttgaccagactgagtaaataaacagatgcaattaatgaaacaaatgaaaaggctgagagcaactggctattctttaaacagattataagtaactaatgggcattaaagggttttttaatgtaaatttttgcttataatttcaacttctattttagattcgggggtacatccacaggctcgatacatgggtatgtagtgtggcgctgaggcttggggtagaaatgactccatcacccagggggtgagcctagtacccaatgggtagtttttcagcccttgcccccatcccctcttccccctctagtagtcccagtacctactgttcccatccttatgtccataactgatgtttttagagttagattaactgtcactatacctaatacaaaattcagtctgggattgtgcctcaggctatgctccacgtctgctactactctaagatcacgtgccctctgtgaagtcactgagctgagcacaccccagggacagggaacctgatatttctcttctatgaatgcactcagcacctcacactggatatataaagaataaggaaatcacttaataattcttggattaaacaaatgaatgcatctgcttgtggaattatttccaattcagtgcaccaaacagggaactttggtatacagccaaccaggctattttaagttttgttttgttttgaaaaaagtatttactgtgagggcttagagcagttacagggctctaaacagaaattactggatactccctcccttcaggacaacgtttgacacatttccaatatcttgtcacgtacaaaattcagaagagcacacctgattcgctggcttggtggggtggatgcttaccaggagatcttgattgacaatgacaccaaggctttatccaaggtggaagttaaacaaagtaaacacggagatgctattcctagaagagaacagcatagatgctgagcgagaatgtacacagacagccactgtaacagagaagatggagaacagcgtagatgctgaacaagaatgtacacagacgcccactgtaatagagaagatagagaacagtgtagactctgagcaagaatgtacacagatgtccactgtaatagagaagatagaggagaacagcgtagacgctgaggtagaatgtacacagacgcccactgtaatagagaagatagaagagaacagtgtagactctgagcaagaatgtacacaaacacccactgtgatagagtagaggagaacagcatagacgctgaggtagaatgtacacagacgtccactgtaatagagaagatagagaacagtgtagacgctgagcaagtatgtacacagatgtccactgtgatagagaagacagaggagaacagtgtagacgctgagcaagaatgtacacagatgcccactgtaatagagtagagaacagtgtagacgctgagcgagaatgtacacagacgcccactgtaatagagaagatagaggagaacagcgtagacgctgagcaagaatgtacacaaacgtccactgtgatacagaggatggagaacagcgcagacgctgagcaagaatgtaaacagacgcccactgtgatagagaagatggagaacagcgtagatgctgagcaagaatgtacacagacgcccactgtaatagagaagatagagaatagtgtagacgctgagaaagaatgtacacagacacccactgtaatagagaagatagaggagaacagcgtagacgctgaggtagaatgtacacagacgtcactataatagagaagatagaggagaacagcgtagacactgagcaagaatgtacacagacgcccactgtaatagagaagatgcacgggatgggaacaactaacaattccccaggaactacagtaggcattttgcttttcatatatatgatttgattctccaaacaaccttttgacgtgggtattatcaaccccatctttctagagccgaaaatgaagttcaccaaatttaagttacttagctaaagtcatgatatcaaacctaggtctttctaacctcttctacctcccaaccaaaaaaaaagtttcttatcaaagcatcatgtgaaacattaaatccatgaagtctcagaaatgcaagtcatctttgaaaacaatgtttcttgacaacgaggatttcttgcccccatattaacaaggttttctcacaacatattcagcaaatctttttcattcaatcaaaatatgttatttgcttttatataaacctaagtttccatggctattgacagaaaatggtgataccaacgtgacaagtacaattcttacagacaaattaataatctgctcatccctacaagctcaagattcccctctaagtaagtctatcagtccttatatatggtagcagtaataagagataccagatgagaatatggacacatccacaaaaattgctaatccctaatggcagtcaaccttattaatagggggttaaagcaggagcattttttaaaccagcgcaagcccagcacttttctaccatgcagaaaatgggtgttcatctctctggatcagcttaagcacacgcatgctattttgtttattatttgggtcactatatctgtaacctaagcagatggtaatatgcattttatatgaaatatttaattaggccatcaaaaacatggcagtaccagctgtcacggcctgctgaccttgggaaaggaggaagtatcagcaaaatgaggatgacaatgttcagatgaaacccagaaatgaagtgtttatgaaaatctcagttgctctaacttaccacacttcaaaccaagaaatgtcacggaagcataatgatccggttcacatcaatcacctacaggtccactgggtttattaaaaactattttcaggccaggcgcggtggctcacgccagtaatcccaacactttgggaggccgaggcaagtggatcacttgaagtcaggagtttgagaccagcctgggcaacttggagaaaccctgtctctactaaaagtataaaaattagctgggcgtggtggctcatgcctataatcccagctactcaggaggctgaggcaggagaatcgcttgcacccgggaggtggaggttgcagtgagctgagatcatgccattgcactccagcctgggcaacagagactctgtctcaatttaaaaaaaaaaaacaaaaaaaagccatttttaaatgatttatactgatacatacatagaaaaactggaaatatgtactgcaaaataataattattatttctagatggtgagctaatgggtgatttttatttaatacttttacttaacgatattttctataatgtacttttatgatttgaaatatttttaatttaaaaaaacagtgacatatacatatcagtccttttatttagtactgtagttcctgaaacactgccttaaaaatccatttttctcataaataaatttgaacacatttgatcctttctcatttctacatgaccacctttacatttttcatatctgaccgccctatcattggcctatgaagctttccaatctcttagcccaagttctttttccaaccaagtcagaggactcctgctactgcaaaccccaggctgggccttgactctgcctgcaagaattcagctggaaccgagtcaactccttccccctttcctcagaggcttttccagagacttctccctttcctcagttccccaacccatcaccatctccctcaaatcatcgaaatgtgacgtattaaatccacgcacagtctcagaaatgcaattcctccttgaaaacaacagttcttgacaacaaggacttcctggtatcacgctagctaacaaaatatactccaaatccttttccattcaatacattatgatacctgcttatgcataagcctaaagcctccatggctagtgagagaatatggtgataccacagtaacaaatccaacccaatcactcctccacctcttcgcccagaaaataaagtctggaggctgggtgaggtggctcacgctttaatcccagcactttgggaggccaagatagtggatcacttgaggtcaggagttcgagaccagcctggccaatatgggaaaacccgtctctactaaaaatacaaaatttagctggtcgtggtggtgggcgcctataatcccagctactcaggaggctgagacaggagaatcacttcaacctgggagggtgaggttgcactgagctgagatcgcaccactgcactccagagcaagactccgtctcaaaaaataaaagaaaagaaaaagaaaaagaaaataaaggctggagacttaagaactttctccagtttccttccctggtccacagcaaatccctctgaccccagggctttgtttccctctcactggtccttcagtgaaattaattcaataaatatccacagagctttaatccagatgtgtgcaagatattggggatttgttcagccaccatcagacacaatctctgctccatcaattctctcccgcttctggacgccagcacctccccatggttgttcgctagagctgccataacagaatactacagactggtggctgaaacaacagcaactgattctcacagttctggagtctggaagttcaagatgaaagtatctataggtttggtttcctccgagccctctctggctggaggagccactgtcttgctgcctcctgacacggcagtccctctgcgcacatgtgctgttggtgtctcttcctcttcctacaaggacaccagtcatactggactagggtcaaccctaaaggcctcatgttaaatcacctcttcaaagaccttctctccaaatatggtcacattctgaagtaccggtggttagaacatcaacatatgaatttgcggggacacagttcagcccagaacacactctccttctcctgggtttctcacttgctcctggctcttctacctcagtcaataacatcctcaaatctttttcatatttaatgcaccaacaacccactcctagtccagatcttccccctgtcctatctagctgcttcccatcactgccaagatgtgaaaataccctaaactagaagtctcaaactcaaatatagaggagccaggagaatcctaagtggaccggatggagaacaagagagtaccagtgcctgctaaaggtggagatcactatccattgccagctaacttcagtcaggtgtgaaaacagagcccagggtatctactgtgttttgtaagagaacccagaaatatatttatatgtaatttcccaagttttatatgctgataataaaaacagaaactccccccaaaaactgtaagtgggccaaataaaataggtttataatctatttttcccctattttttccctataatctcttaaatttactttccccatttcctgacctgtcactcatcctcacattaatgaaaacaggcttctttgtaccaattccttttcccagaccccacttaaacagctaatgctgaagcccccatatcttacctgccatgcttcccttctcaagtgtgagctccttgaaagcagatcctgtgtctctatatttccagtgctgagcactgtgtccagcatagaatgtgggctcagtaaatgattactaaataaattggcttaactctttctttagaacaacccaatgaaatggaggaatgataaatcaaagaatcttacctttgtcaaagctcaccacttaatttacctatttgcttcactggtttagcaagattctggaccatcatgtcacatatatactcttacatggcacgacagcttaaaatccccacttttccttcaaatggcacaattgagcttccaaagagacaaatgctgatatcattctgtcatttacccaaaaggtccatttatctgcatgcttaacattttagaacacagtcaatcatcagaaggtaagaaaaaaattctatgaattgtcaaaataggtgattaatgttcattcattaatttcactcataagcaaactcttcaggccttgactcagaatctcctggcttttaatttttaaactattctaacataacttcatttgcaggagaaatacatcaggccagaactatcttttacatctgttagcctgagagccagacttaattcctgagataccagtgtgctgctctgcggagggggttcctttgaacccactccgaactacactgaatttagcctcttctcatctgtcacttcacttatgaactgtcaaaattactccagaagggtggagtctatgaagatgacaataaaagaagttttgtacttaaaaggaggcatggaatttagacgtaagaagacagaaacctagggtggtccttacaaggagatacagttcagctatcacaaattagctcaagaaaatacttaggtgtcatctctttctaacaaagttattttcttgaccaggaagcttccagtgttccaatgaagtgctccaaaccctcttttctttcactataaatgtgggcatggtctccctcctggagtcctttcccatgaaatatccagtacagtcatgcgcagtctagccacaactcgccacaggaaaagcacaatatgagggacagtgttcactctcatacatctctgcttttgttcaatccaggcataacaggaattagacaggactagattaaaagttcccagttccggcccagcgtggtggctcacgcctggaatcccagcactttgggaggccaaggcagacagatcgtgaggtcaggagtttgagaccagtctggccaatatggtgaaaccccgtctctactaaaaatacaaaaattagctgggcatggtggcgagcgcctgtagtcccagctactcgggaagctgaggcaggagaatcgcttgaacccaggaggcgaggttgcattgagctgagatcgtgccactgcactccagcctgggtgacagagagagatgccacctcaaaaaacaacaaagacaacaacaacaagagcaaacttcccagttctgctacactcttaaggcaagttactaaacttttctaaatcttcacttcctcatatgtaaagtggggatcacaatattaaagcctataaaagggtgaacaaatactaaattcactggtgtgatgaattacccatcatgctgtcttcaatttccacgtctcagctgaggctttccctgatgctgcatgtgtggcaaggatcgggctttctatagaaaatattgaataaaataatattcctccactgtttttaggacaacttcaattagatgtggaaatactagggaaaaaagagtagtcttaaaatgtattttataaaaatctagatacaacttaagcctaaaataaatttaaaaaaagaaaaacaaattaatccagatgacatataactaaacatcaaaatggggaaggaaggaaggaagggaaacctacattgaaatctattctaccataaaccaacatgaacacttctgaaaagaatgtaagaggagttctgggctatctcttaagtaaaagcaacaggaatcccatgggtaaagaaacttgtaataaagaggtatttagactcaaagaatctcacagaaatataagaaatagagttagggtcatatggaatgttctagtggtaccaaaagccacacaaaaatgacagagaaaaattatgtacagaacttgtatgcttgaaaaaaaagttacagtattattcttctcttgctaccaatgcaaaacaaaaatcaataaccaattctgttttcagatttttatccactgtgctgcataaaggcaatttggggactgtctgaacagaacttctaactcagcatcttctcagacaagtagatttgtcattctaaccaataaataactagtcatactgtggctaagagagcactttatatttaatgctttaataaagctctgaaaaagttgggaaaactttaaaaccttagccactttagagtaatcatattaaattttaatatagttttataaactgtataacagctcagctgatttaacaactgtaaaaagctaaattcacagaaaaataactcgtattaattattgaattcacttttcagaagcactgattcaccgaaagtgatggcagactcagaagcttctgaaggaacacagttgagttccctaaacatttcattagtgggcattaccagggaacacaattctatgccaaacgtataaggcaggttttaggacttcagattacctaaaatgaacataataatgagtagtcacttctataaagatactggatattggatataaaaattaaatatgtgttatttgacacacctattctctatgaataggctgtaccacacataaaacatcagaaaatctgaattcttgtgtgtaggtcattcatatgtttactcctgtcttttaaattcatctttatcaccatcagatcctcattacttattgtctggatgcaggtttctcttttacttacactgcctctccttccacgttttcatcgttatcagtggcccatgttagtaggttaatcttagtttgtgagcctgaagatctcttagcgctccaagatggaactggtacgtgtcatcttatttccatctaaatacagcataaggagtgaaaaaggtcaatggactgggagttactaaataaaggtgatgtggaaaacaaatcataacataggagtataagctaaaggaaagggccattatggtaatatctatcaaggacacttacaaacagtaaaagacaaaaggacatacaaagaaacgtacaacttaactaaaacagaaaagaaaaaagaaaagctctgaagtctacaaaattataacaacgatgggatatgaatcatgttttttcaattctaagtggaaggaagaaaaataaatcacatgtgcctggtaggggagaatttgcttaagaaagttttctcattttagatttgcttttggggtagatggtactttttcactatattcttcaatctcaagttttcacaggaatcacattaataagagacagggactggacaataacctggggagcagtaaatttgggggttattcttttgcattaattggtctagttaaccaagatgtgcaaactgccagagtagaagtaaatctacattctcaaaatttttttaaaaatgaagagtgacaaggaagaatatgcctcattctagcaaagtcatatctgaagagagagctgggaaaataggtgagatttgaaatttgtgtctatatgatgtaagacaattttagaatgatagttattatctcataggctaaatcaaagcacagctgtctctctgcatgcacattttgattctgcaacagaggtcctgcaagagccatcataatgccagcaaattaaataaggagagtttgaaaggcccagtcattgtgaacaagactgaggctatttcattcacttcacgtggtgaagtgcattacgaggagctgatatgactgtaaaatgtatggagacactattaagctgaaaggaatctagacatgtggatagttccctactcactaacacttcatgataatagagttaaatattctgaatagttcacttctaagggattaatacacttccccagtactcaaaatcatgtctgcctttcaacttatttgaaaggttcagtaataactcctcaaatactcactgcttgtcatattctaaatactgaattcttagatgcaaacacgcagctcctattagggctaacggaagctacatgtttgtaccaagggaaaaacatacgtctagaaaactgttctctgctgctcataggcaatcacgttgcatgtcctctcgtggacggtataaaaatgcgtgactatttacgcagaaccattcaggtgttacaggcacttccatagcatccaagaatgcattagccaaaaccaactaaagtagtttttgggctcatgatcattcaagctgaatcaataatattaaacagcatgtggaatgggggaaaaccaagtgtaaagcaacattaaaacctctttccactcaagcataattcattttgatctttactactggattcagctaaaggtcaaataatatatgatgatttagattcagaaaatatattatttcgctgttgagtatagtctgaaatgagggcaactaatttaaaaatggaatcaattttaaaaatataaatgtaataaaaatgtctccatcacagaatatacaaattaagtcccactattgattactgccaacattttaagcctccctactcatattggtaatgtctttagtgcaacttaattttcttcatattgtgtcatacacattcaatgaacatcattccagtgagggaccaagaacgaggtcagaaatggctgtgatgataaattacagaccttaataacttctgaacaatttgaaatgtaaaagccatctataagtcattcagcttgatagatgaatggttaatgaattatacaaactaataaaaaccattaattatttatctgtactacaaaatggcataaggccaagatcttaaacatggtctgcattaagaccaaaactgggattcagggtatatataacaagagggggaaaaaaagagttatctattagaagactgtataagcaaaaatcacttaagctttataagcatagaagattttattaaaggactggtcagattcataactgacagaccactgaaatattatcagcattggggtaaaaaaaaaaaaaggtaactggttgatttagatgtttccttgttcttttgctttttgttttcagtgaaaggcagtttgaaatttccgtcttagtggtttgtactgcagaacactgagatcaagacttgggtacttttgtatacttgcatttcttgctcttgcatgagtcccaagcagtgatggggggctacccctccccactaaggaataatcacattccagtttctggaaagaactcaaattagtctgactctagtgaatcaagagcaagtccaagatggaaacacaggagaggcaacctgggagggaacagactgaacaggtaaaactacagttagtagcctccccgttcatgaattacaactgacaaatgacatcttatctggtaactctgtcaaatcttcactaattcttcgacttcagtatttctcaagaatggctcttctactaccaatatcagaatcacctagagagcctgtttaaaatgcatattcctaagttactttccagacctcaggtaacaggacatattccagaggtctggaaataggtaacagacctcaccaagtgtggggctgagaaagcttttaatgatctgcccaggatattccaatgtgccctaaagtttgagagtcacagtcctaagaggatgctctccattacaccaccctgcagcaatggtgcctaccatcacacgcatagtgcacatgtcagcaacgtaagagatgccaagctcttaagtgtaacagggtgccttgaatattccctaaatatgtgagaacataggcatgactggatggataaatgcatgaaggagaaaactaacagtacttctgatataaaataggaattctgattcctttagaattggctctacagcactttgggaggccgaggtgggtggttcacctgaggtcaggagttcaagaccagcctcaccaacatggcgaaaccccgtctctactaaaaatgcaaaaattagctgggcgtggttgcgggcacctgtaatctcagctactcaggaggctgaggcaggagaatcacttgaacccgggaagcggaggttgcagtgagccgacattgtgccactgcactccagcctgggcaacaagggcgaaactaaaaaaaaaaaaacaaaaacaaaaaaaacagaattggctctacaaatccattcgcagctctccaaaaatccccaaggtgctccaaatttctcacagtctatatatttgaccgtacgatcttaacttctcaggtattgatcagagaaagtcgagaggaaggaggaaatgcagggcttcaattctgatttcgcagaaacatgagtgctgcactgctttcggccccgcatggtgtgctggcagacaccaccactgtcccaggcgcgtctgctgtgaaagccgttgcttagcaacagcaatcaatgctgtatttcctcttcaccattttcctgaagattgagacactgctccaaggtatcattttcaaataccttctgtttcactgaccaaacatgtttgttaatttttctattataggaaaaaaaaatcatgaaccaaattggtctaagaatccaggaaagaggagtgagggaaggtcagtataacaccagtgctttgggatttgtttgatgaagaaaaattctttgacagctcattgactttatttgctataccgtttcattctgccattttagcattgatttctgctacctcatgggatatgaaagtcgttagcatgaattatcattctaaatgcagatccacaaggtactgccataaaacacaaaaagcaaatgattttcagagactggttgaatacacatctcacatctctgttaaagctcttgtcttggtcatgttcttattaaccaataacaacaaaatgttaaaaaaaaataaacatctctccactgataccacaatatataattctttcagatgggcaatgtttctactaaattaattgtacctgtgatgaaagcatatagacaataccaatatttaccttaggaaaaaggcagagaaagtacacaagagggagacaaataaaagggggaagaggtagtaatttttatcaatatgtcctaccaatgaatagattcttcatataaaaccaaaaatgagacttgggaactttacatgacatcttccaataaagaaacttgatacttgcttgaagtatatacgtgcagatatgttagtaagtggtggaatccaacaaggtggatattgtgtgatatttatttttcatgtttattgaatatctactgtgtaaaaattctatgggtagcataaagatgagtaaaatgtaatccctgtacaagattgtggtaaaaaaaaaaaaagtcacataaataaatacagaagaatacatattacctcagataatcactcaagtatttagtaacaacaaatattccacttaaggtggattatatctacaacagacaaaatgagtaaatcggaatcaaaagcttttatttttttaaaacactcaatactggtaaggatgtagcgacataaaaatgcatcatgtgccagaaaagacacagggctggtaaactaaatcaactttttcaaagatagttagcaatatgcaacaaaacttttaaatatgcaaatttaaaatgctgacacagtaattgtatatctagtcaattatttcaaggaaataaagatgccaacaaaagatatttatttctgctacatttaaaataataaatactaaaatgttcaatattagaagaatgattaaatgcataatggtaataattatatgataaatgagtaccattagggtattcaagaatattttatgaaaggaaataattcctataatgttaacaggaaaaacataaaagcagccaatacataaatgcatagataaaatagtggaacaaatgaaaatgctaatgatttttggtgatttttattttcctctctttattttttctatgcgtttctaggttttttgtattgactgtctactgcatatttggtcaccgaaaaatgtcccaacaaataaaatctatcagtctcatttgacttcctattaaccgatctgttttatttcaacttagaacttcaaccctcactggtatcaagtactgccaagttgaatgatagtactcttaagtttcccaagcatttttagaccagcagtttttcatttccataaagatctaataaatttggttaatattttccacagagaatagctgtaatgaaagcataaaatttaagttaatctaaacaacaaatatgtaccaagcacaaggcatacaaatgtagacaggacgttcttgggttatgagaaatggatttcagtaacttgctctcccttcagtgtccttccagaagatatggggccttcaggtacagcatttctctggtgtcagaatatatagtctgtctacaaaaggagctctagtatcatccagggcaggtgatgacactgtctacaactgctaaccctctaccatcagataaactaaagagtgaaggatgcagagaaatgaataaaattaaaagaattctgtcaagggaaattagtattctttcaaccttcctcaatctcatatgatgtcgacacagatacacaggatatcacatgctctttttgtcagttacctgtgactatggatgctgacaaaagcacttttctaaacccaaacaccaagggccagactttccaatgcttacacagcagcatgtatgttaatacctgcattatcaaaggaggaaactgaagatttggaatggtgaagtacattggctagggtccagctcatccgcaagaagacaaaactccagtgagttttgagtcaggttatctcctaagtccgtgtttccaccattatagcacatatgatctttgagaaaatggataggagaaaggcacccattgcaaaggaataacatgagcaaaacagagcagcagaagtcaacagaacattctcaggccctgcacacccaagtttgctagaacaagggcaggggaacactcagctacctggtttgttcacccaacctgccctgtctactgcacttccacgccaggacagtggccctgttcaaaggtcaaaaccagtcccactctgatgctcccctccctggctccattctcacttcagcatgatgatcttctcatggtccctgagaatatcttagcatctgtaatggccatcggccattgagtaaatcccagttttaaacttgcctataaagaacgaacttagtgtgcttttctgctgctttctctcattgaacacagttctttctcttccttcaagaagaacctttctgaagcaccttgaatttcctagtttataatctctgtgaactcctgctatcaagagctctgcagagctagcttccataacctgtcctctttggtgactctctcgtaacaccaaaagctcccttctaacaccaacaggcaaaagatggtcatggtttaatattttaggtactgttccagaattagccagactgtggttcttaatgtttgcatctgtttgtttacagaaatggtggtattgatctaatggaacactggaacttggtctttacaatggcaagttgtggatgataaggttgaaaaagacaagagaggagtctagaaatccagtcagagattagatttcacatcccaggtcacaaaatggtagggagataatacatttgtgaaagctttatttggtaaaagaatgcaagataaccaaagaggagacaaatgtcatagcaatccagctatgagttgtgtactctgtgctggaatggtaaaccaagcatggcaagatatctcaaaggaaaaatgaacagaactgtcaattaactgtatatgaggtaaaacaaaggaaaaaagacaaagagatgagttttgaaaccaatatgttgaagctcatagtatcagctcatttatttaagtgaaatatatgaaggaattgtttaaaataaaaaccaaggaatttttaaaatagcatgccaaagtaagtaaatacataataagtatgcctccaagaagtaaggctaagagagaaaccaatttagatcagtggcctctttcaggaagagagaaggttctgccctatccagcattttctataaggacaagagaaaatattttttcagtcttccaaagacagctaccggaatatttaggaacagtcctaaaaatcaagaaacagaatcttctgaatatggaggaatgatcattaaaacaaagaggaatggagaatagcaaagccattttgcagctaaacttgctgagccccaaaattatccactcatgtttatgttagcagtactataaaacttatatatatgctctattatcaaatacatttttccactttctagtaggtaaaattcatggaaacacttaattttctttatttatgcagatttttacctctctaaaaaatgctgctgctgagctttctatttttgttcattccagttgaaatgcgatgattcatcggtcatcaccacaatggccacacgcatgtggaagagaagctcatgattctaatctgcacagttgctggcggctagatatgcctaaagaggatgtgaaacagcagcttcacttccaatggagatccggacagtaataaaacagtttcgcaatctcttcactaaatacatctttgtttgcatggtctatgtatattgtcatggggcaggtgcaggaaaatataaaatatacatatttaaaatcctactgagctgctgtgaagtcagtgacaaagaaaaacacacacacgctggggcttcatgcatgtagttaaataaataactttgagatcatcaaaaagagtcagcacacccatatttcttacttggcgctcattactgttcaaagacaccatttttttttaatgctgagccatcttaaaactttgtcaggcaacattaaattcttcaagtcttaagccctaaagaaagttaccagtaatgggcagtaacattaagttagctttgcatttaagaaaaaatatttatccatctgccttctcccacagagtactttggatcactctcagtggccatcgttctctgtcctgtcttcatgcagctgggctgagcagcagcatgccacagaaaggggccagcggaactcaactgtccaaagaaatgtccaaactgcttctgttacgtaaagccaatgtcactttccttttttaaaggaagccctggggtgtaatcctgcctgagatgagtccactgacacgacaaaaatctaaaatgtgtaactatttggaggaaagtcagtgtgtatcttccacttgaaaggtataattccttaaaagggacataaaaatattttttctattgtatactctaacagtcaataactcacaaggaaaccgaatagagagcgaaagatggagcactctggactaatgtgaaaaacaaactcaaggccgggcacggtggctcacacttgtaatcccagcactttgggaggccaacaggggcaggtcatgaggtcagcagttcaagaccagcctggccaacatggtgaaaccccgtctctactaaaaatacaaaattagccaagcgtgatggtgcacacctgcaatcccagctactcaggaggctgaggcaggagaatcgcttgaacccgggaggcagaggttgcagtgagccgagatagcgccatggcactcctgcctgggcagtagagtaagactccatttcaaaaaaaaaaaaaaactcataagcagacttcaggaaaatgccaaacaataaaatacatctccatattggacaatatggtgaccccaacaacccagatagacgcactgacaaatatcttctaaatgcatcagtacattgtttgtaccctcatttggggaaaaatatgcaaaaaagatacctaggaacaagtgggaaaatctgatatggattaggtattacagaaaatattagagaattgttactaattgtctaagacgtgctatggcattgttataaaagagaacgtctttgtttttagaatgctaacaattgatgaatctaggtgctaaatttctggttgtattccttcaccttttctgcattattgaaaatataataaaaaatgaagaaaaataaaggcataaaagaagttgtatttaaaaagagaacattaaaataaaattcatgatttaagtgataagaaagaaatatccttagagtattacagtcaagtaaagataccaggccagtaagtaaactctgaagctagctttctcactagaaacatttagctaacctgaggatcctgaactttccccttgacggagacgtgggcacaaagcactggaggctgtgtgtgggcctcatccagactggaaagtctaaaaccaaactcctgaacagacctaggattttccaaggactatatgctgtgagttagaatcactgtaaattacaaaaaatctattccacacaagggagagcaaagaagttctcaatctagaccctaaatactggacagagggggataatttttttctagactcataagcagaagttggcatctaaccaagcttgtagcctaaatttatattatctttgtgggagaagaaacctcaagcccagaaattaacctgagcaggatccaaggttgttaatgccttagttatccatcaaaacaaaaggcaaattcactcagggtgaatacaccttcaatccaggcctcaaagaatttctaaagagtgtgaacttacagcttaaaaaacaaaatcacaagccagggtaacgtagggagaccctgtctctacgaaaaattaactgggcgtggtgatgtgtgcctatggtcccagctacttggaaggctgggatgggaggatcgctcgagcccgggaggcagaggttgcactgagccgagattgtacaactgcactccagcctgggtaatagaccaagaccctgtctcaaaatataaataaactaaaaattctcacaaagaaaacaaagaaacaaagatcagtgaacaagactcagcagaagtattatattgctgaatcaactcacaaagagtttctaatttggtattatcagaatttaaagtaaatatgtttaagatgtttaaaggaataagagattgaaaatatgaggaaggataaagaaaattttttaatgtctagctaggaaaaaaaataccatctagaaatgataaatataattgtaattaaagtgctaatgtaaaaattggcaacagtttttaaatcccacaatgtcaaatgctggtgaagatggttcagtacgaatgaagtcaactttcagaaacaatttgacattatctagtgaagttgcaataagcatactcatggcccaacaattccattacaagttatatatccaagaaaaactcctgtacatgttcaatggaagataaatacatgaatgttcatggcaatgatatgtgtaacagttaaaaacagaaaataaataaactatggtacattcatagaaaacaatacagcgataaaactgaatgagttgcagttacatgaccatcacgaataaatctcagaatactaggtcaaaaaaagaaagtagacaagaatacgtacactctgacatgagtaaagttaaaaacataccaaattataacacataaaaaactgatttcaatacatacaagaaaacctgttaaaaaaaaagccagtgaaaggaacataagattcaagatagtgattatttcgtggggtggagagggagataagagagagaagcagttgtgcagctttaaaagtagtggcaacaggccgggcgcggtggctcacgcctgtaatcccagcactttgggaggccgaggcaggcggatcacgaggtcaggagatcgagaccatcctggctaacacggtgaaaccccgtctctactaaaaatacaaaaaattagccagggggtggcgggcggctgtagtcccagctactctggaggctgaggcaggagaatggcctgaacccaggagacggagcttgcagtaaaccgagatggcgccactgcactccagcctgggtgacagagcgagactccgtctcaaaaaaaaaaaaaagtagtggcaacactgtatttcttaagactggctgactgctatgcaagttgtttgtttactgttatttgtaccttatatttaaggtattttgtgtgtgttcaataaaaattatttaacaaaacaaaaaagcaataatactcacgggtatcttagccaaaagcctgaagctatactagttctgcacacaacaaacatgctttagaaaaagaggaaaccagtaacattcaggaatatcatagcaagacaatcacatgcttctggaaaatacaggatactgtggtaaggaaatgaccaacgttgtcaattctgtcccctttccagggatgtagatctccatttcacagagcaccaatagctttatctgtatgcctgggagttgtcaagcctctcttttatataggttgggcttaatttaactaaaactcctgattttcccctccaactattgatagggacagggggcagagaaattctaggcagaaaatggtggtccccaacaaaaccccaccttcaagcctcaaaccatggcccaaagtagaacttacatccctgtttccctgcttgaatgctgccttttccaaaaccacctgtggccctatcccaccccaccctgtgcctataaaaaccccagatccagccagcagagagaagagaagcagctggacatcaaagactgcagctggatgtcggagagaagcagcttgacttcagagggacagcctgacggggtaactctggagaagaatctggccagagatgaccgcatttcacaggaagattaccttcctgccccatccccttttcagctcaccttgccactgagagccacttccattggcaataaaactccctgcatttatcatccttcaattcattcgtgtgacttcatttctcccagatgccagacaagattctggagccatgagtgtgaagacaaaaaggttgtcacactgaccctttgccctcgttagcagaaggcagctgcctcatgcgaaaaggcagagggcccattgagctgttaacgcataagccgtctgcagagagcagagctaaaaggtcactgtaacactccctctggggctttcgtggtcacaggcactcccagcccccagatgcagctgcaggcaagcacagagttggctcctgccagcaaccaaaaaacactcacccaggctcctgcactcacacacctgcatgcctcctttcatgaggggtggaacgcagcagatccgactgagtggggttcactgctggtgccgtagtggctggctgactccagcgaccatgtactccacctcccaccttgttgactcatgcactccctcctgtgaggagctgagagctgcaggtgagtaaacagaacacccctgttgcaagtcccacgagggtgtcagggaaatatactgcttcattattgctgttcatttgatttcaaatataatgatatctaaacgcaattttttggcatttacgttcctctaagcccagccttaaatttagatgatgaaaatcttaaattgtcccaaatggacactacctccttccacatctgttgactaggatattgatggtagtggccattccagacgacccactgctaccatcacaccagctgcagtgaggaggaatggccgggcctgcacactccacagagcagggagaagaccccacccgccccacccgccatgctctccccaacccaccatgcagctgcagacccaggcacctgcagcctcccaaaccatggctgcagacctgggactcctgctccacgaagcaggtgggagccccacctgcctgggcacagctgcagctgaccaaaccacagctgtggatccagacatccctgcactttggggggcccaggaaggcccctgactgcactcacagtctcagaaatgcctgcttcagctgcctggcttctctctgctatcgatgcccactccgacctgggagcaaagtcagggctgagtccgggcaccatgaacagcagcaggaggcaggcaggttcctgggcggatggggcctggtcaccagtgaggccccattgtcaagccaggaagggcctgaaggctgggggctgggctgccagttccggggcatggagtggaaacttgtggtgccttttccggcccacccatggccacctatggaccaatcagtgcaaacttcctcccctctgaggcctgtaaatgccccaggctcagtcagagctgagcagactgggacaaccagctgcagagaggagctacccactccagggtctcctctctagactgagagctgcagagatggtactaccagctgcagaggggagcaacccactctggggcctcctctctgctgagagaacagacagatgatgggacgaccagctgcagagaggagctaccctctctgcctagagctgcagatgatgggacgacctgcctgcagagaacagtctcttactctagggcctcctctctgccaagagctggagacaacggaacaactagccaaacagagaagctaccctctctgctgagaactgaacactcgttgggatgacctaccagcagaggggagcaagtctctctgctaaggagctgaacgctcattgggacatcctggctacggagaggacctgcccactgtgggttttctctgagttgttctattgctcagtaaagctcctcttcatcctgctcaccctccacattgcatacctcattcttcctggtcacaggacaagaactcaggacccaccgaatggtgaggctaaaagagctactgtaacacaaacagggctaaaacatgccccttgctcgccacgttgtgggcaaagagaaggagaaaggagctgcaacccttcgggtagcccagacctgggagctccctgagccagggctgtgagcccttctttggggccctgtggttcctggcatctccaagtttccgggatgtcaccacattccccggtgccagacgggaaagccgcttgcagtgaacccggtccagccacagcctcacagagagctggtgctcacgccagcacctggagctgcccacaccatagcagcagctggtgtgtctgaccgcacagtgggcggaccccacgtttgctgacacacacccctcaccactccatgcctgactccagactccctttgaagcacgggatccaggctggtagcatgagctgagcgcagcctgccagggcgagtgggtggaacaagcccagcaggtccaagcaaaactcaggcaagggcaccaccagtcacatgtttccggccagaaaagtgacaccccaaagaccccatgacagtatgacttatatcctgttatattgtctcatcacaattcacatagggttgaatctgctattttgactgtttgtgatgttttggctagcatctgaacagatgggcagtttttcttcagtatgactatttgccaacaattggaagggtgtaaaactcattctcagagcaacccaaacataactacaaggagtctaacagataaaatatccactgttgtattcagaaatcctgtataaagtgccagtgaattaaaagaacactttggtaatgtggttaaatgaatgctactaataatcataatagaactggaaatttgtataggtattgtgttcacattcatctgattatcatagctctaagaaatagatattacaggtattattacggactttattatcgacaaggaacaaagcacagagagatccatattacagaaaatggactgaactcagaaataagaacaggatttgagccgatctgtgcctcattagctgtgtaaacttaaacaagtaacttaatttctcacagcctccattgcctcatttgaacacgcaagcacagtgagacctaactcacaaggtcctcctgagaattatataaaatatataaaagttatcagcaagagctcctgtcatagagtagattcttcatgaatatatccttccttaatttatgaaatcctccttgataagaagaagtcaaaacttttatcattactcttttcacaaaggagtcaaaggtgatttcaatttagggaaaaagaaaagtttagacctaaaacattaatataaactgaaggatgcaaagaactcaatgttctacaatcatacttcagtggcctctcattgtctcctgaagaaatatacagaatataatgagtgggtcaccatgcggtttagaaggggcagagttgtcctacagtaataatcacggtacatttgatgctaaatcgtatgtgctctaatattgtaatttcacatctaatacatgaaaatctttccaatgaagttagtttattccctatagcatgaagatagatgaagttaaatagtttatttcctatagcataaagatagcccttgacattcattgtcacacatttcctgtttctgagatcagtaatttgtagattccttcctgaaggttccagcaaagagcttttacccatctgcccaactcctttgattcaagacagggaggggaacagaggtctcctcaggaaagagagtctcctgtacccagggtgaggagaaaagtggtcataaggaagccgtggggccacagatgtatgaccactcacaactgattcagtgagccaagaagacagcagtgttgccagagatggaaggtgttctcagaatgctaacaggacttgctgatgaaggggatggtggtaggggatgacagaaagaattaatcaagagcgatgccttgattttggtcctgagcacctgactgggagtaactactgaactggaaaagatagaggcagcctgagtctcctgtaaaattcagacaccttccaatctccataattctagtttcttgttcctggacctcttgctttagggaggcatatagcactttacaaagtatttgctcattttgtcatcttatgtatatactgaaaatggagtcagtgtcaccagaaaggacacctaatactccttgcttttcttatggacctacgactatactataggtgctgaaggtacctatacctatactattggtattgaagggacacaaagatttgacctaaccttagagtcactttgtaggactactaccccttctctgttttcctccttcttcattaactcttcccttacctgacaagcacagctgactggaattgtgtacactaaatggtcctttacaatacggaatacttcagtaattacaatatgctggaattgctaaattctataatttcatttggatgaacttaatcacatcatagcattcaatttggcttattttcaaaatcagcttcgtttataaactaaaaagaactgaaggattcttttcattttcaagacttctcatctgtaagaggatttagattcttctatttacaagcattcttctgagaatctttcattctacacacaggtttctttgggggttctgttttatcttttttcatacactgcctaccagagagaacaagactggcaaaaggactctgtcctcataaagctcagagacgatgaacagataaacaagtaagtgaacaaaaatacttcagataatgctaaatcctccaaggagaatatgatacagtagatgtaatgggaagctcctttagactgagtggtcagagaggacctttctggggtggggtgtggcatttgaactgtgccctgaagaccgaagcagtacaagcacaggaattagcaactgcaagggctctgtttgataatgaacttggtaggttaaagggacagaaagaaagccagtgtggctgaggtgtggtcaaggggatgtatccaaagtatagcaatacatcagagaggaaacccaggggcagatatattagtactgaaatagcataagggattcacactgtattctaggtgtaatggaagtcgatggaaggttttaagggaaggtgcagggattacctaattcatattttaaaaggtcattgtgggcgccactgagaaagaatatagaggagcaggaaaggaaggaggaggaggaaggacagaaggaagactactatgattgctcaggcaagatatgatgttacgttagactatactggtggcaaagaaagcaggggaaacagactttagacatattttaaagaaaatgttaataggacttgctaatgaattcagtggtgatgggggtaagtgacagaaaaaaaattaagagtaatgactagatttttgtactgagcacttgactgggggtaattattgaggtgggaaaaacagaagcagaaaaaggaaggtggcagagggagccgaggaatcaagagttctgctctggctatgttgagtttgagatgcttttcaaatatccaagtgaggatgaaaccagtagatggctggacatacgaacgggagctcagtatagcaatcaaggctggagatacaattttttttttagtatattggcatcaaagagggtatttaaagtcatagaaataaattagaatcctttaaggagagggtttatttaacgagaaagaaaggagaagaaagctcaggactcagcctttcataattccagtatttaaaggttaaacagagcatcaacagccgtcaaaagatgttgaaaagaaatggctaaacagagggaaaaacaagaagagtgttgagtactaggagccaagataggggtcagttatgtggaagactgctgaaaagtcaaaaaaaaaaaaaaaaaaaaaaaaaaaaaaaaaaaacagaaaagacaccagatttggcaagactaaaggtctttggtaaccttattagaacaactgtaatgaagtgtcagaaaagaaagtcccattagaatgggctgaaaagagaatggaaggtgaggaacaggggagaaggaagagacaataactacatagcagtcttttcagaagttgtgcacaagtgtgtgagagagctagagcacaggagagcgagcccgcaccagcacacacttaacacaggtgacaacagaagttacggaaagacagtgtctctggagcatctgtaatcatctccttctttgttttcctcttcgagtcattctgctgaagttcctgaataaaccatacggatctacaacatacatacatctcagacctagtatctcttttgttcaatctctccatatttttctgccaaatctaatcagaggttttgcggagggattcgtaacaactatattcttcatttttaaaaatgtgtgcaaaatagtagcattcggtaaatattacaagattgcaaggctagatgtatctcaaagaacacaatacaaaagatgtaagatgctcttctaactggaaatggtggaaacttcattatgaatccaatttccaaattatttccaataatgaaggccaatgtatgatctagtcacctttgacaagatcggtttccataatatgtttacttgctttttttcacactgtctcccaatctgttctttgaagtttcttcttgcctaaaataaacttccacacacctgctctataaacccgaactcaaagtgtagcatttttacctccataaatgttttggacactatgctgacagaagaagaagaggaactaaatgacctgtgaaagcccctgttagttgcttcatactgataccgaatttctaaatgtattataaatgcatttcacagcattccattaacatgtcagaggactttcttttccactaagcacactttgcatgagttaaatatcattcttttaaatttacataaagacaagttaaagatgaggccatgtactacagatttatttaatctacatgagacctaagatatattttcatcaatggctgtgctagaataattataaattacagaaaataaaacattcagttagtggtatagtttgcctagaattgattttttgatgctgattatataacccattaactgactaaaacttcttcactcgagtcactgcagcgtctgccaccatttgtgttagtgtttacacataaagatcacacacatttgatgcgtccactttccttcaaatatgggttagagtggaactgggaaacagaaccatttctagtctttttacagctttgttattttgatttttaaatttacatttggaataaagagaaactctgctataagaatctcatactaacctctgaataaagtggagatatgcaagtactccaagaaggcaacagaattaaatatattttctatgaaagatattaaaaccaaaagtgtttaataatcttcattaatgaactttaaagctcaagaagaccttataaatcatctagttcatcttccttggtttcaaaatctactcttgaatttatttagcattatgagattattagatgaggttatttattctccctaattttaatattgataattaatctttaataaatgcttgtgatttttgacatattaaattctaaacctcaacatttcaaacagtcttagatcatgaagaatattaaccaagtccaacgtcccatatactttgtagtaaaatggtagaccctgaggtgaagtggggcaataatttcatgagaacacatcacagtacatggttagatgtactttccactttttcttctactagaaaactaagtttctgttttgggaagtgctggctttgtgttctgcccgtttatgctttaatttcagctcatgcactggggcgccctcaggaggattaaagaagacaactttggccgggtgcggcggctcacgcctgtaatcccagcactttgggaggccaaggcaggtgaatcaagaggtcaagagatcgagaccatcctggctaacatggtgaaaccctgtctctattaaaaatacaaaaaattaaccgggtgtggtggcgggcgcctgaagtcccaactactcaggaggctgaggcaggagaatcacttgaacgtgggaggcggaggttgcagtgagctgagattgcacaactgcactccagcctgggtgacagagtgagactccatctcaaaaaaaaagaagagaagaaagaagaagaaggaagaaggaagaagaagacaactttgagtggtggatgaaactccgtcctaaagattccaggctggagaactgggtccttttagccatcttattaacagtttgaacttgaagagatcacttaacctctccagccactctacctttatgcataaaatgaaaataatattagtttacacataagtattcaaataatttcctaaggtctcaccgatctctaaaaatctgtgataaatattttcataaaatagatttggcatcatatgctatgttatttatatttacctaacaccacatttccttatttttattccttttttttttttttttttttttggagacaaagtctcactccatcacccaaactccaaactacagagtgcagtggcagatctccactgactgcaacctccgcctcccgggttcaggcaattctcctgcctcagtctcccgagtagttgggattacaggcgcatgctaccatgaccggctaatttttgtatttttagtagagatgggttttcaccatgttggccaggctggtctgaaactcctgaccttgagtgatccacctgcctcagcctcccaaagtactgggattgcagacgtgagccactgcgcccggcctcacatttccttatttcaatgtttacttcagaaggccctaaagcagggcaattcaactggcttccatgtttacttatcattaaaagttatcttacaggactcttgggattgtgtcctttttaagacaacacaaagttcatagagtaatggactgtgtggtactcctacccgaggctccaacattttgaggcataagaaaatcaagtatctggttctgatttccactctactttgttgccatttttagcaacagttgatggcacttgacctgatctctttcctggtccattgcctataggtcaagctgacagcagcataaaaccctaaacagccataactttttagtatctattaatagatacattttatggtggctgaagtgacaatctaggttcctttggttaagaagttcaaaatctttattctactgctattcctttctgtataagtttctcagagaaaacaaggtgtttccagcagcaccatcactttatgaaaaaaattaaacctccatcatctaaatataatgttttttctaaaagaagccttcttttttttagtatgtatattatttttagatacttccattgctttaagaagttcccatgatctttgagacaaaaatcaaaacatctttgggatgacaaaactaaaaatgaataaatagataaagtggaatttttgagccaactttttttacattttcatacaaatttcgaagctacaattaacttcatttagaccatgaatagcaacctaatggggctgtaacaatttccacaaataaagctacactatttgtttcacattcactaaggatgactattactctaaatgttcaattagttcttcatttattttaaaattaaattcattataaaaataatgttagaatattatccaataaattttctttgctcaccttcaaaaattctacattaccgttctcttgagaaattctacatttggtttttgttcctcatcttatcatcctgcaataattctttgaaatccatttatcttactaattttaaaaaaaagggattagtgtctatttaaatcaaataattagtaataacctattgaataagtttgtgatagaaggtgttacattgtttcagtctacctgccattgaacaaaataatgccaataatttacttaatcctattgaaatttaaattttgcaactctctttatagaaggataaagtttacaattgccctttatccatcttatagagatgatgcaaagttaaattatgcactaccatagtctgttttcgcagttataatgaaatacctcagactgggtaatttaggataaacagttcacagttctggaggctgggaaggtgctaatatccagcaaaggacctctgactgcgtcatctcgtgacagaaggcaaggggcgagatacagcaagagggggccgaattcaccttttatattgacaccaatcccacccatgagggtggaactctcatagcctcatcacttcttaaagtttccacctgttaatactgatatagtggcaattaaatttcaacacgcattttggagggacaaacattcaaatcatagcacgtgcctttcaagcgttttgaggtattcagaaaatggcaagatactagaagtattttaatgtgttcctaaaacattaaacctaaaacagacttatatctaccttcagctctaaaaatctgggccttcaagatttttccaagtgttaagcaggtggaccccaaaagtgaggcacaaacttcacattatccaaacacatgacaacgtttaatatcacagtatttaaatgctactctaatgaatgtgtgaagattttctaatctggtaattcaccgaacttttaggaaccatgacttttcctaaagccatgacctggttttcttctgaactacatgctattctgtatataatgctccacatgtttacaattgctccaagtgatcaattcattaattctcaaacaaatgacatcaatctttttttcacatgtaaagaaacaaaggcagaaagagaaagaataggccatttccctttaatctgcaatcgctcaccagaaagatttagtttgcataaacacattcaagaaaataagcgaaaataaattttaaaagaagtacataggaaatgacaacgtaaggaaaatgggaaagggaagagagaaccaggagttaggctagaatgctgtcctatcttgtgcattgccaactctggagagatccaataatcagtccaaggtaccacacaggctagacctgaactcctgggctcaagctatcctcctgcctaagcctccaagtaactaggactacagtcgcacacagtcagaactagcttgttggacttatttttgtcaaagaatagtatcataatctttgtgcctctcttgattgagaagaaattctcccagagcagaactgtcctatagaactttctgcaatgatacaatcttttctatcagcaccatttaatatggtagccactggccacacgtggctgttgagcagttgaaatgtgtttagtgcaagagaaagacttaatttttaatttgattttaattacttaagtagtcaaatgtggctactggttaccatatttcatagtgcagttctgatacatatgtacagcaaatcacagcaaatcaatttctctcacagtagtatctctctcagttactcagtttcctaactttgacagaactatttatcatatgatgtatattttcacctgaatacttccatatgagtctctattttattccagagaatttttccgattacagacttagtgtacttttggccagtgagttgtgtgggttattgctaagcatggcattggacgtgctcggatgcttgtcttcattcattcctgaaagcagtcttattctctaaaactatccatcattcttactcttctctctcatcccagctgacatgccactttcaaataggtatattttctctggtttcctgcttttctgatatagctgtggatacatggagagtgtaataaacgggttgtccagaaaggagcttctgtagtcactgggcagtagatatcagcatcagcaatagatctatttaataaaataagtaaatatatatccccactatatggaagagtataatacataaaagcatgtaatataacaaattttatgcaccaataattttttacagtattcagaaaagtttctacatagtaactataaactacatattaaaaattgttttctggtcattgctataatgtacacacacattccaattgacacacagaaaaaagaagttactttctttaaactgcaagggaaatatcaaaataacatcacgaaacatttcataatatcctagagatagtatctcttacatttcaaaactgctttaactcatatggggctccagttcatcagaaacaggacttgatacaaaaaggcatggcatgaatgataattactgctttgggtacaaatctgcacacattacatgcaagatccaatataagtcaacttctcacagcaatcaatttttcaaaaggaagggtacaaccaatgtttattttatgttaaggagaggaaatcaaacaaaaggggaaaaagtgagatgaaaattcttatgctccagttgagtttttccttgggagcactgaacagattttaggaaatttagcctaattttgctatggcaacagttataacacttgagaccacagtccaggagaagcgcagcatttattctcttattgcagcactttgatcctttccgagtctaacttaaaagccatagtttttaatgcaaatgagaatacatacattgagattcgggaataattagaatatttatatttgtaataaatccaatggaagctcttttgtgacatgaagcttactcagtggttagggggttaatgaatgaaatggatcactggactgaaaataaaaatcactatttaaaacgaaggcgacaccaggagaattaggcactacataatactgtaaccacggagaattctcaacagtaaaataaagccctgtagtcccagcattttcattacttttccagtagtgctggatgcagtgtgaatttcaatgaggtgggaaacagtggctgctccctttaaagaacatataccacacagaggaaagaacatataccatataccacagagaggagaagcactccttcaattcacacagtgatgaacatattccacagagaggagaagcactccttcaatccacactgtgatgaacatataccacacagaggagaagcgctcctcaattcacactgtgatgaacatataccacacagaggagaagcactccttcaattcacacagtgatgaacatattccacacagaggagaagcactccttcaatccacactgtgatgaacatataccacacagaggagaagcactccttcaattcacacagtgatgaacatattccacacagaggagaagcactccttcaatccacactgtgatgaatatataccacacagagaagaagcgctccttcaattcacactgtgatgaacatataccacacaggggagaagcgctcctcaattcacactgtgatgaacatataccacacagaggagaagcactcctcaattcacactgtgatgaacatataccacacagaggagaagcactcctcaattcacactgtgatgaacatataccacgcagaggagaagcgctccttcaattcacactgtgatgaacatataccacacaggggagaagcactccttcaattcacactgtgatgaacatataccacacagaggagaagcactccttcaatccacactgtgatgaacatattccacacagaggagaaacgctccttcaattcacactgtgatgaacatataccacacagaggagaagcactccttcaattcacactgtgatgaacatataccacacagaggagaagcactccttcaatccacactgtgatgaatatataccacacagaggagaagcgctcctcaattcacactgtgatgaacatataccacacagaggagaagcgctccccaattcacactgtgatgaacatataccacacagaggagaagcactccccaattcacactgtgatgaacatataccacacagaggagaagcactccttcaatccacactgtgatgaacatataccacacagaggagaagcactcctcaattcacactgtgatgaacatataccacacagaggagaagcactccttcaatccacacagtgatgaacatataccacacagaggagaagcactcctcaattcacactgtgatgaacatataccacacagaggagaagcactcctcaattcacactgtgatgaacatataccacacagaggagaagcactccttcaattcacactgtgatgaacatataccacacagaggagaagcactcctcaattcacactgtgatgaacatataccacgcagaggagaaacgctccttcaattcacactgtgatgaacatataccacacagaggagaagcactccttcaatccacacagtgatgaacatataccacacagaggagaagcactcctcaattcacactgtgatgaacatataccacgcagaggagaaacgctccttcaattcacactgtgatgaacatataccacacagaggagaagcactccttcaattcacactgtgatgaacatataccacacagaggagaagcactccttcaatccacactgtgatgaacatataccacacagaggagaagcactccttcaattcacactgtgatgaacatataccacacagaggagaagcactccttcaatccacactgtgatgaatatataccacacagaggagaagcactcctcaattcacactgtgatgaacatataccacacagaggagaagcgctccttcaattcacactgtgatgaacatataccacacagaggagaagcactcctcaattcacactgtgatgaacatacaccagaggagaagtgctccttccactcacactgtgatgaacatgtaccacatggaggagaagcactccttcagttcatactgtgatgaacatataccacacagaggagaagcacttcttccattcacactgtgatgaacatataccatgcagagaagtactccttccgttaacaccatgatgactatatactgtacagagaagcactccttcagttcacactgtgatgaatatacaccgtatagaggagaagcactccttcaattcacactgtgatgaatatataccgtataggggagaagcactccttcaattcacactgtgatggctattggcctatccatgccactatgtagtttacattttagtatcttaaaatatttcatataatagaatattgcatttaacttgcaagaaaggctaaacacctagcataacaaaccatggtgcactgtaaatgttaatttaaaaataatatatacaaatcagttacagcttagacaagaaacctctttgactacacaatttggaactagaattatatattatatttaaatgtatctctttaaaccaattcaaaagcaacatagagagactaaaacctgtactgaagaaggaaaatcaggtcattacccatgagattgcttcagttcaaaaagagaaagcaggagtaggtgtgaaaatgcacagattactgaaaagtggaatgtggcgttaaatcaaatcttacaacatggaatcacgttttactttgcattaggttcctatgctcctagtatcaaaactaggaggtcctttgagctactaacttagtaaaaactaaaagtcaaacatttcactaatagacctgcctctaagtataaggttgaggcagaagatatacaatcatagaagaaaagacaggagttaataccgctttccccactgtaactggaaagtgtcataaatcctacattagtttctcacctaacctccctatatttagtcattccagtgccccaaaattgaagaattagtctcaatttctactggaatataaataacacatcagcttctagccagataattacgtccttcctgaatatgttgcaaaagtgttattcattgtggagaatgcagaattataaaatacaacccgactctcaaattacttataatctggttaggaatacctaactataaaaataaacacagttgtgggtctcagctgggcaacagtcaggctctgcaggatgtctagatagacaggtaggtagacagacaaaaagacatgtatggtgagccacctccagctcacaggcagtatcagactcacagtagtaccaactcaaaacagaccttcccctccgcagcattccgcatgccccacattatgctagaacctctatttgaatttttcttctagagcaaattcctagcctctcctctaggaaggggagggctggggaaagagcccttggggtcttttcaaggggttcactgaccctacaagctctaagctctctctacagctgtgctgtccaatatggaaatcatgagccactgagtggctactgggcacttgaaatatggctagtgcaactgagaaactgaattttttatttaatttaatgaacttaaacagccacatatggctaatgactacaatactagaaacaagatataaaacatttccatcatcacagaaagcactactctacagagtaaagacttattataattggatatatacattcctgaaaaatgtggtatataaaatattataacttgagggctcataaggcagaacactcaaactctatacagtattataaccaaatccctaaaaagtaagaatcccaacttttaaaactagcgtgatttttaaaagacatttaattcttaataaagaaatattatgataaataagtatacatttaattatttatttatggataaatgaatgaatgaaatgaatgacagggtctcacaatgttgccgaggctggcatgccgtggcgcaataatagctcactgcagcctcaacctcctgggctcaggcaatcctcccgcctcagcctcccagtagctgggattatagacacatcccaccacacctggctaactttttttatttaattaattaatttatttattttttgagatggagtctcactctgtcgcccaggctggagtgcagtggtgcgatctcggctcactgcaagctctgcctcctgggttcacgccattctcctgcctcagcctcctgagcagctgggactacagaggcctgccaccacgcctggttaattttttgtatttttagtagagacagggtttcactgtgttagccaggatggtctcgatctcctgacctcgtgatccacccacctcggcctcccaaagtttttttatttttctgcagaggcggcatctccctatgttgcccaggcttgtctcaaactctggggctaaagtgatctacccacctcagcctcccaaagtgctgggactacaggtgtgagccaccatgcccagccaaccatacatttaaaggttaaagtagcttgaaagaaggctgtaagaaaggtatctaaattctgaaaatgcacaaagactgggaatactatggccaaaccaagcgagagacaagaggtctcgggctcactgtttctccattcctccaccttgctgggctgtgctggcgtttactgcactttgggtttagctgctaccacttgatgaagaaaaccattaatacatcaagaaaaaccacttaataaaccaaagagacgaccacattaactcaatagcatccccccacttgtcaattctatgtgaattaattcttgtcatagaaacatgagtaggcgcagaaaggacttcatttggcagacaggttctctgtgtgtgttccctcatactccccgatataactggtcgcagctccattcccatctcagtctatcaaaaaaactatgcctgctgctcaaggcttttctcaactgataccttccctttattaagcctttcctgaccatcgcctccaaccaagatatgaggaacacagacttttttctcctaaagatatttttactcacacttcacattaaatttaacacatacttatggttgttgttctattactgttattactagaggtagcttaggagggctgctggaaattcaagggggaaagctaaaacttcccagggctttgtaacatctcttcagactggattttagtcctaattctgccaccagcttcctggttaatctcagtaagtcactccctccccgtttctgggctttaaacaaactcatttttcaaaatatctttattattgtaacttttgaatgacattttaaaagtccctgtaaacctctagtatgcacagaactttaaaaagctgaagtgagaatagccttctagactttttgccacatgaatatatacaaacataaaagcattttacactgaattagaccatgccatccgtatcgtactgtgacttagtttactgtattcacttaaaacttgatttcagtacacaaagaaatctcctgcagttgttttacctgctgcattattagaaaaaaatataatttaacaatcccccattgattaaattaccctttaaatgtttaagcttttcttaaaactaggaaagtaatacatgcatttttttaagtattgaaaattttcctttccctaatacactctatcttgggtgataaaattttctaaagagtatcttctgttttttcatttttctcatagataccactggggtttctttctctttttttaagacaaggtctggctctgttgaccaggatgaagtgcagtggcacgatctcggctcactgcagcctcaacctcccgggctcaagcaatcctcacacctcagcctcctgagtagttgttttttgttgatgttcttgagatgggtatcattgtgttacccaggctgcactcgaactcctgagctcaagcaatctgcccgcctgagcttccgaaagtgctgtgattacaggagtgtgccaccacacctggccaggtttcaacgatgcattcctatatttacttcttgacttttgttacagcattattttacactgtcagtgattatttttaattcattaaattctattccataaatagatcccagtcctctgtgctttctcagttgatttttggagacagatagtcaacaggcagcattcacaatattataattatatatctattactcactgtagaactaagtattgtggaacagctccacaggggaggaaatgcaatcttatgccattcaacttctcctgtttgaaacaaaatatcccaagagtcaagcagatttcattttcgtttttttgcttttctttactttacctgcaattctttcttacatctcagattatcttctttcttggattcttctaccatttcattgcagaaactccttacatatattatttcatataagaagcctagataattagataaaaaatagcttatatccatgcatatttgagtatctttctatcactgccttcttacttaacaaatagttttggctacatgagatttttggttcaaagttattttctttgtttggtttttttttttttttttgagggaaattactttttacttcagtgcaatttactggagagacgaactgtgcaagtagagatgcctgatgagcgtcacacaacgttttcggtggatagtcacgacacttgagcccaccacgaaagcaacgggaggcagctgcaatattccagcaggacagtgtgtactacagtgagttttaagcagttatgattttttaaattatactttaagttctaaggtacatgtgcacaacgtgcaggtttgttacatatgtatacatgtgccatgttggtgtgctgcacccattaactcatcatttacattaggtatatgtcctaatgctatccctcccctctacccccaccccatgacaggccctggtgtgtgatgttccccaccctgtgtccaagtgttctcattgttcaattcccacctatgagtgagaacatgtggtgtttgattttctgtccttgcggtagtttgctaagaatgatggtttccagcttcatccatgtccctacaaaggacatgaactcatcattttttatggctgcatagtattccatggcgtatatgtgccacattttcttaatccagtctatggacacttgggttgattccaagtctttgctattgtgaatactgccgcaataaacatacgtgtgcatgtgtctttatagcagcatgatttatactcctttgggtatatacccagtaatgggatggctgggtcaaatagtatttctagttctagatccttgaggaatagtcacactgtcttccacaatggttgaactagtttacagtcccaccaacagtgtaaaagtgttcgtatttctccacatcttctccagcacctgttgtttcctgactttttaatgatcgccattctaactggtgtgagatggtatctcattgtggttttgatttgcatttctctgatggccagtgatgatgagcactttttatgtgtctgttggctgcataaatgtcttcttttgagaagcgtctgttcatatcctttgccaactttttgatgaggttgtttgatttttttttgtaaatttgtttaagttctttatagtttctggatatcagccctttgtcagatgagtagattgtaaaaattttctcccattctgtaggttgcctgttcactctgatagtaggttcttttgctatgcagaagctctttagtttaattcgaacccatttgtctactttggcttttgtttccattgcttttgctgttttagtcatgaagtccttgcccctccctaggtcctgaatggtattgcctaggttttcttctagggtttttgtggttttaggtctaacatttaagtctttaatccatcttgaattaatttttgtataaggtgtaaggaaaggatccagttttagctttctacatgtggctagtcacttttgccagcaacatttattaaatagggaatctttcccccatttcttgtttttgtcaggtgtgtcaaagatcagatggttgtagatgtgtggtattctttctgagggctctgttctgttccattgatctatatctctgttttggtaccaggaccatgctgttttggttactgtagccttgtagtatagtttgaagtcaggtagcatgatgcctccagctttgttcttttggcttaggattgtcttggcaataagggctcttttttggttccatatgaactttaaagtagttttttccaattctgtgaagaaagtcattggtagcttgatggcaatagcattgaatctacaaattaccttgggctgtatggccattttcatgatattgattcttcctatccatgagcatggaatgttcttccacttgtttgtgtcctcttttatttcattgagcagtggtttgtggttcgccttgaacaggtccttcacattccttgtaagttggattcctaggtattttattctctttgaagcaattttgaatgggagatcactcatgatttggctctctgtttgtctgttattggagtataagaatgcttgtgatttttgcacatcgattttgtatcctgagactttgctgaagttgcttatgagcttaaggagattttggactgagacaatggggttttctaaatatacactcatgtcatctgctaacagggacaatttgacttcctcttttcctaactgaataccctttctttctttctcctgcctgattgccctggccagaatttccaacactatgttgaacaggagtggtgagagagggcatccctgtcttgtgccagttttcaaagggaatgcttccagtttttgcccattcagtatgatactggctgtgggtttgtcataaacagttcttattatttagagatacgtcacatcaatgcctagtttattgagaatttttagcatgaagggctgatgaattttgtcgaaggccttttctgcatctattgagataatcatatggcttttgcctttggttctgtttatatgatggattatgtttattgatttgcgtatgttgaaccagccttgcatcccagggatgaagccaacttgatcgtagtggataagctttttgatgtgctgctggattcggtttgccagtattttattgaggatttctgcatcaatattcatcatggatattggtctaaaattatcttttttttgttgtgtctctgccaggctttggtatcaggatgatgatggcctcataaaatgagttagggaggattccctctttttctattgattggaatagtttcagaaggaatggtaacagctcctctttgtacctctggtagaattcagctgtgaatccatctggtcctgaacttttttggttggtaagctattaattattgcctcaatttcagagcctgttattggtctattcagagattcaacttcttcctggtttagtcttgggagagtgtatctgtcgaggaatttatccattttttctagattttctagtttatttgcatagaggtgtttatagtattctctgatggtagtttgcatttctgtggggtcagtggtgataccccctttatcattttttattgcatctatttgattcttctctctattcttcattagtcttgctagcggtctatcaattttgttgatctttccaaaaaaccggctcctggattcattgatttttgaagggttttttttgtgtctctatttccttcagttcttctctgatcttagttatttcttgccttctgctagcttttgaatgtgtttgctcttgcttctctagttcttttaattgtgatgttagggtgtcaattttagatctttcctgctttctcttgtgggcacttaatgctctaaatttccctctacacactgctttaaatgtgtcccagagattctggcatgttgtgtcttcgttctcatcagtttcaaagaacatctttatttctgccttcatttcgttatgtacccagtagtcattcaggaacaggttgttcagtttccatgtagttgagcggttttgagtgagtttcttaatcctgagttctaatttgattgcactatggtctgagagacagtttgttataatttatgttcttttatatttgctgaggagtgctttactgagaccatcgatgctaggaagaaactgcatcaactaatgagcaaaataaccagctaacatcataatgacaggatcaaattcacacataacaatattaaccttaaatgtaaatgggctaaatgctccaattaaaagacacagactggcaaattggataaagagtcaagacccatcagtgtgctgtatttaggagacctatctcatgtacagagagacatacataggctcaaaataaagatatggaggaagatctaccaagcaaatggaaaacaaaaaaaaagcaggggttgcaatcctagtctctgataaaacagactttaaagcaacaaagatcaaaagagacaaagaaggccattacataatggtaaagggatcagttcaacaagaagagctaactatcctaaatatatatatgcacccaatacagaagcacccagattaataaagtaagtccttagagacctacaaagagacttagactcccacacaataataatgggagacattaacgccccactgtcaacattagacagatcaatgagacagaaagttaacaaacatatccaggacttgaactcagctctgcaccaagtggacctaatagacatctacagaactctgcaccccaaatcaacagaatatacattcttctcagcaccacatcgcacttattcaaagttatttatctttcagaactttgaaagtactgttccgtgatcttctagaattaaatgctgcatatgagaaatgtgattttagtccagttcctgcatgttttgtcacttattttttccctctaggggaatatgttggtatatatatattttctatggagttctaaaattttactaggaataattgagtttttgacttttttaaatcatgtgattcaacacatagtgagccctttctatctgaagaattataaggcttttttcagctttgtgaataatgtttttatcatttcattgactatttccacccctctatcttaactatcacctgcctctggaaatcctattagaaagacgttggtcttcacagatcttaacccccaagtttctaatttcccaaattatccattaatcagttatactgtacattatatatatgaatattctgggaggtttcctgaactttcctttcaaaaatcagtctttggctaaatctattctatttgttggcccatatatcaaatgttttgttatgaaatcattctaattcttggaaagagttttaactatttcaagattattttgaatcttactttgaaagtttggtgtagaaagaattcttacttgatggactaagaacacaagagattgagagttaagattagaaagaaataacattctacacgttttgtaaaaggtggggattttttccttatttttaaaaaatgaataaaagccaaccaatctttgttgggcatggtggcaaatgtctatagtcccagctacttgggagacatatatgtgtatatacatatatatacacgtatatatgtacatatatgtgtatatatatattttaacatgggactcatatatatatatgagttaaaaaaacattttatttcattaatatctcttgtacatgggaaactgtcacaaagcagtttcttctctttttactatactctaaacatagactatatataaaagaggttagctatagttcctgagtcagctactcatcactcatttcccacacctaaaagaggccaaggacacttaaatgtaaattcattgtacttttcacctttttgagtgaccccattttataggtatcttggggctagctatttgcacatcagacttttccattctgaaatgctgactcaattcactagagagaaggattctacttgtgagtgtggaaaaaaaaaatcctgactttctagatcattttccctattcactttggataataccactttataaataggatttgatgcatgcaaagcagcaatctgaaaggaccggcagtatatactataagcacttattatagtatttgtaaatgccttattaatggcaaaatagctttgaaaccatccatgatatgtaccacagctaactcaatttgacagtgaaagatgctatgtcagtctgttatggcagatataaaacatgtaccatatgagtagatccttggcatatgttataaaaattacttttgctttatattttctagttgtgtaaaaagggacaagaagcactcctaacactgttttcattggactcttccacactgccttctgttgcctactataaacagttaaatatatcttcttttactatctggctacagcagttttctgtatataaaaatttttccactctactatgaattgggtttatatggactccatctaaacattattcatgaactattctgaatacataccaaatgataccccagtgatcttcaaaacgctgaagtttcaattttctttaattctgctatcaggccaggcaaagcattcatctcagtgaggcagcctgcctcttaggcatcattaatgttttagattttcataaattccactacggctaaatagaccaagaacctgaactccatagagttcctaaaagaattcagcagctactgcctttttttttttttttttttttagttttatttccaagatgaagtttaaaaataagaataaaaactggcaacaggccagacatggtggctgaggcgagcggatcacttgagcccaggagttgcagaccagcctggacaacatggcaagaccctgtctctagtaaaaacacaaacattagctaagtgtggtggcacatgcctgtaatcccagctattcaggaggctgaggcacgagaatctcttgaacctgggaagcagaggctgcagtcagccaagatcgtgccactgtactctagcctgggtgacagaacgagactctgtctccaaaaacaaacaaacaaaaaacagaaatactgggaataaaagtatttttgaaacatgtagatcctcttttattaagaaagaggcagacatctcacacttaggaaaatctcaacccttaaagagagaaatgaaatagaaattttacaaatcaaaacaaaagtaaaaaaaaatcaaaaataacagatttttatctaagaaattaaaatttcagatttaacgtggaaaatatctgaaaaatgttgtgattatgaataagccttatgacatttctgcatcacttcctgacttatagacctatttctctaaattgatattcattctacaccaatgaaccactaaaggccttgttcatcaagattccagaggtgatttctattcatattttgctatgaatacaccaaactgtatgaaaagttagtttttttccatttctgtaaatataagtttaataaaatacaaccacagataacacaccaggccaatgtctcagtcaattaccaacttagccatgttttcctatccaaaaaattcatttgtttttggtgacagtggtgatgaaatcatttatttacttatttttcatttggttttcatgaaatacttgttccagtttgttccatgtaggttttgagaaagattacagtattttgttgttctaataaactgagacattcagttctatcagacaacgatcttacttttattctagctgccagaaaagtcacagctaaagttgacattcaattatggtggctttctttagttaaaaaaattaataaaacgttcttctcttcccctttactacctaacttttgcctttgttcttacggtatgatccttgatcttactgtatctgtagttttattttaagtaagaagtgaggactctggacattgctctagttgttcaaatgagattctatgtggattgtaaaaatatatttttctactggaaagtaagtctatttgagtagctagggctcctgttgtaatagaaagggtaccaatcccaagtaatatgatttctaaaatgaagtcattatcataagtggagtatattatttcaagtgagtaaaacttttgaagagtgaattgttcatattctgggttatgtatgcatttgttacggtcaaggaagcttgaagcttcaaattcataaataaattacatcaaatgcaataagaataccacctactggacactttataatatgcattaatagtatatttatgactttatttaatttctaaaatggccctatgaagttatttttagaattttcattttacctatgtggaaactgagccacatagaagatgcccaaataacagtatttctgcagaaatcaaaacccaatttgcctgactctaacatttacactatatatattttatacatatatactatatatatatgtaacacatatattacactgtttaatataattacagtctcacatagggatgaattcgattattcagataattaaaatgttttttaaaagaaaataatattcagcatatttcttcgttagttatatgttaaaatacgaagatacacatcaaactactaaatcaactaagactaaatgctcttttgtatataactcccttattagacctgaatgttacagaattgtaaacttaatttggcagctgatctgaatccaggtcgctactctgtagtcagctgtgttgtatgactctgcactgagacccagaggaaccacaatgaaaaattagctgctcagtataacgaattgccagatgctggactcaagtaggtaatgacatttgaaagcatgtgtgcaagtacagaagaaaattctgaggtcccagatctcaaattttatgtgttataagcaaaatgctaaaatctcaagttccatttttaaaaattaattaaataattatttataacgtgtgtctaggcaaccacacattcaacagactaccaggacagattttgcctctagcactgtggtttaagaaagagaaggataactctctctctctctctctctctatatatatatatatatatattttttaacatgggactcatatatatatatatacacacgagttaaaaacattttatttcattaatatctcttgtgcgtgggaaactgtcacaaagcagtttcttctcttttttccgcactctgaacatagactatatataagagaggctagctgcggctcctgagtcagctactcatcactcatttcccacacctaaaagaggcctttttgtttggcaaaatgcttcccaaagtaaatagaaacgacagttaacactttttattttctagctaagagtcacctattgccttcaaaaaaataaattcttctagtagattacagaatttgctttgaaaaattttggtagacttttatccttaaaaaatccaggtagcaagagaacctggataagtactgcctggattagcgagcggttatgagcaaacgctatctgagaagtaagttttcatgagtgatgagaacataccctttcctgcttcgctgtccctcaccatcaaaatccctctcaccaccttgctgaaaccaaccgttgcagagattcattctattgatgtaaggttgggtctcaactgaaatagttaacaggcagagagcatatctcttttgaaactgtatttggagtaaaaggttcggatactgagccactgataaggtgtttggaggaaattgtttcataaaactgaaaagcaaccgtaagaaaataaggttggagccaatatgacaagaactgatgatgtaacgattctgcccagaatgttctgaccatgtcatcaaatcatgccctctaagcaatacaagacacacaagagaagtcttcacaaaacacacgctgggctctcacacactcattttcggattttgaagggatttcacaagatttcaaatctgcccagatcatctcaaaattgttcatttctaaacttgaaatgtctcccaacagagactttttggaaagtaatttgggcaggtcgtttgttcccattatcaattaccggtcagtatgtaagtagctctcttcccatgtcaaagctgcccctggccttcctcttgctcatgctctaattgtgttattagtcaggctccaaagtctgagtgtagctccatctaccacaccctctgggccagttatgcaaaagctctctgactttcctttttttttttttttttttttttgagatggagtctcgctctgtcgcccaggctggagtgcagtggtgcaatcttggctcactgcaagctctgtctcccgggttcacgccattgtcctgcctcagcctcccgagtagctgggaccacaggcgcccgccaccatgcccggctaatttttttttttttttttttttgtatttttactagagatggggtttcatcgtgttagccaggatggtctcaatctcctgacctcgtgacccgcgcgcctcagcctcccaaagtgctgggattacaggcatgagccaccgtgcccagccgctctctgacttcttttacctaattcacagtatttctctgagggtcaaataagatcaagaacaagatgcgaaaactacaaagtgcattttaaaataggtgattactgggatttttttttagtatttgatttttttatagtatgatcattgctttttgtttcttcatttgtttttgagacacagtctcactctgtcacccaggctggagcaaagtggtgcgatctctggctcattgcctcccaggtttaagtgattctcccgcctcagccttccaagtagctgggagtacaggcgcctgccaccacacctggctaatttttgtatttttagtagagacagggtttcaccatgttggccaggctggtcttgaactcctgaccttaagtgatccgcccacctcagcctcccaaagtgctgggattacaggcatgagccaccgtacctggcctgattattgatactccacacaaaacacagaaaatacaacacaaatatggaaactattaaacaattatttcaggttttaattcacaaaaatgcacccagtatggatcctagttttttgttttttttgtatttttttttgtaatttcctaaatgtactgggataaaatatttctgaaaaaataagctctataaaaattttcaattaaggttatatttgatcatcatagtagtacagcccaacaaaacagttttacctaaagtaacatgaaaaatataatttctgtttcacccttaaaaaatgtgtgtttgtatttatgtacttccaaaactttttcttatcaactaataagatcaggtcacgttaagtctattgatctcacctttcactgtaatatctgctttggcaactgttccttagatacaatgttctccaaactcaaaagttatttccccactggataggtgattttgtactgtttatattaaactttatctcttttcttctaagagcagctcccccaggtagtcaagtctgttccatgttagcttactttcaaattaagtcaccttctggcatgacacaattatagagcacattaataactgcaggcacctgcagaataaattcaaacgcattcctttccctccccctctcttgatatatacctgcaaaactgtctaaaaattctataaaatctaaaactcaaaaatggtcttctctatattcctgtgttcctccttactgatactaggttctaatactctgtcttctaaaacctggcaacactatctaatctattctcaccctgtgatgactgtgactgctgaaacctcattttcatagtccaacattcaaatcttcaattgttgcttgacaaactcagttatcatggaatagctacctgaagaaaacagctgaattcagtacactattttcagtgactgcaaaactataatacacaatacagatatttttcacataaactaggtgtaaaaatacaatgttcacacttcatatgagaatattttatttctagaaataaatcttcaccagtccaaacacgtaagtttacagaaagtcagtaagaaatcattatatttatatagcaccttgaccactacaaaagctgctcactgataatatcagaaataatcaataggcttataacactgccaaaatggtagcagagtatcgtgtgtctattgagtctgaaattaaattgcaatttaaggtccatctcttaaagctatattcatgtatttagaactctatcaaacaaaacaagaaaaaaattactttgacgtacatcttttaaagatgaatatgaaactttggacaataaatactactctcccgaatcaacttttaaagtgcaaccatcttttaatgatagttaactgctttaagaaagcaataaactaaaatgtaaacctgaaagcccactatcttaagctcttttaaaaattaaatacaccagcaacattttgagactcaaaattaatttacttcactcaatcctatgcataagtttggcaatttgtttcagatgctattttttctgtaatttttgtgggtacatagtaggtgtatatatttatgggctatataagatgttttgatacaggcatgtaatgtgaaacaagcacatcaacaagaatggggtatccatcccctaaaacatttgtcctttgggctacatgtcatttcctaatgtaaagaaaatggacagacagaaccaacattgatttgactgggtgaaaaagtccatttgagttgggagcaggggttgtgttcctggatttgggttgttaggacagtataaaaaggcttcacaggggaacattcttttctgataaaggaaagcagctgggttggcttcaaatagcagtgactttacttggaatattcacaggtaagctgcaaatataaaacaccttccacagagtgttattttgtaatcggggcttatctcaagtgcaagaacctccagcctacagctttagtaggtgcctcagacactgtgcccggctttagtaggtgcctcggacactgtgcccggctttagtaggtgcctcggacactgtgcccggctttagtaggtgccgcggacactgcgcccggctttagtaggtgccgcggacactgtgcccggctttagtaggtgccgcggacactgtgcccggctttagtaggtgccgcggacactgtgcccggctttagtaggtgccgcggacactgtgcccggctttagtaggtgcctcggacactgtgcccggctttagtaggtgccgcggacactgtgcccggctttagtaggtgcctcggacactgtgcccggctttagtaggtgccgcggacactgtgcccggctttagtaggtgccgcggacactgtgcccggctttagtaggtgccgcggacactgtgcccggctttagtaggtgcctcggacactgtgcccggctttagtacgtgcctcggacactgtgcccggctttagtaggtgcctcggacactgtgcccggctttagtaggtgcctcggacactgtgcccggctttagtaggtgccgcggacactgtgcccggctttagtaggtgcctcggacactgtgcccggctttagtaggtgcctcggacactgtgcccggctttagtaggtgccgcggacactgtgcccggctttagtaggtgcctcggacactgtgcccggctttagtaggtgcctcggacactgtgcccggctttagtaggtgccgcggacactgtgcccggctttagtaggtgcctcggacactgtgcccggctttagtaggtgccgcggacactgcgcccggctttagtaggtgcctcggacactgtgcccggctttagtaggtgcctcaaacactgtgcccacgtactctgaatggcgtatacacaatgataataaaagataacacagtgtttgctaagtgccaggtacaactacaggtaccgtaccagatagaaactgttattataaccatttgacagataaaaacactaaagcacacggagatgagtgaatttgcccaaggtcacatagacagtaagcagtatgaagaaacatatgtataactgcactgactctaaaatattataaatttattctgttaaaggtttctgtttaaaaaaaaatccatgtatttattaaaagtagcttttttctcagattcacttatagcaagactttattacatattaacttatcactgggtacaaaccacctggttctaaagacgtctgtcctgattactgtagggactgttatatatgaggcagaggcatcttttcattattattatttcccaaaacctatagaatttgtgtatagcagttatagactatgtctgaaatagttatattcacataacacttaataatcacatttaagtattcactaacagaacaaagcctgttactatggtaaataaatacacacagttctatcacagagcacagaagtcatcaaacagataatattttcttcattacacactgaaacttgtgacccgctaacagcataaaataatgtttaatatttaataccatgtgatggcaatactcaaccaaacatgtatttcaaatgatatgttatttgacatttcaatttcagctcaaaagtacttctaaaaaggatgaaaatatgtgcctgaaactgatagtttgaatttaataaatttttctgggattgttgtgttttgaactttaattttagaaccaagggggtacatgcgcaggtttgttaccagggtatattacatgatgctgaggtttggggtacaaatgagcccatcacccaggtagtgaacacagtttccaccagttaggttttcaacccttgctccctccctccaacctcgagcagtcctcagtttctgctgttgccatctttatgtccatgagtacccaatgtttagctcccacttctaagtgagaacatgcggtattggttttttgttcccgtattaattcacttagaataatgacctccagctgcatccaggttgctgcaaaggacatgattttgttctttcttaaggccacattgtattctgtggtgtatatgtaccacattttcttcatccagtctactgttgctaggcacctaggatgataccacatctctgctattgtgaatagtgcagcaatgattcttccaatccatgagcatggaatgtctttctacttgtttgcgtcatttctgatttctttcagcagtgttttctagttcttgtaaaaatgttttacttccttggttggatgtattcctaggtgttgtaggtgtgtatatctactgcaaatgagactggattcattatttggctctcagcttgaacgttattggtgcatagaaacgctattgatttctgcacacagcgatgaacatgcaactatatgtctttttggtagaattatttgttctcttttggatatgtatccattaatgggactgctggatcgaatggtagttctgctttaagctccttgagaaacctccaatggcgttccacagtggctgaactaggtttatattcccatccacataagtactcccttttctctttttctctgctgcctcaccaaaatctgttgttttttacttcttaataataggcattctattaaaaaaactttgtcagatgtgtagtttgccaacattttctctcattctgtagactgtacactctgttgatagtttcttttgatgtgcagaagttctttggtttaattaggtcccaccagtcaatttttacttttgttgcaactgcttttaaggacttagccataaattatttgccaaagtctatgtccagaatggtgtttcctagcttcttatagtttcagatcttaaacttaaatcttttccccatcttgagttaatttttatataagatgaaaggtaagggtccagttccattcttctgcctatggctggcaagttgccccagcaccatttattgacagggagtcctttcctcattgcttatttttgtctactttatcaaagatcagatggctgtaggtgtatggctttattttggggttctccactctgttccactggtctatgtgtctgtttttgtaccaggaccatgctgttttggttattgtacccttatagtatagtttgaagtcaggtaatgtgatgcctctggctttgggctttttgcttaggattgctttggctacttggactcttttttggttctatgttaattttagcatacttccaattctgtgaaaaatgacactggtagtttcataggaatagtgttgaatctgtagactgctatgggcagaatggccattttagtgatattgattcttccaatccatgagcatggaatgtctttccacttgtttgtgtcatttctgatttctttcagcagtgttttctaatccttgtaaaaatgttttacttccttggttagatgtattcctaggtgttgtgcatgtgtatctctactgcaaatgagactggattcattatttggctctcagtttgaacgttattggtgtataaaaacgttactgatttctgcacacttattttgcatctgaaactttactgaagtcattgatcagtttcaggagccttttggtggagtctttgggactttacaggtatataatcatatcacttgcaaagagaaatagtttcacttcttcttttcctaattggatgccttttctttttttcacttgactgactgctccagctagcacttccaggactatgttgaataggagtggtaagagtgggcttccttgtcttgttccagttctcagggagaatgctcccagtttttgtccattcaggataatgttggctatgggtttgtcatagatggatcttattattttgatggatcttattatttgatggatcttattataataataattattattattattattttccttcaatgcctggtttcttgagggtttttatcatgaggggatttggggttttgtgaaaagctttctctgcatccattggggatgatcatatggtctttatttttaatactgtttatgtggtgaatcacacgttttgatttgcatatattgaatcaactttcatcccaggaatcaagcctacttgatcatggtaataaagtttttgatgtgctgttttatttggtttactagcatgttgttgtagatttttgggtttatactcatgagggatattggcttgtcattttcttttttgttattgtgtcttcaccaggttttggtatggaggtaacactggcttggtatagtttcaaaattggtagcagctcctatttgtacaatacatctggcagaatctggcagcgaatccatttgtctggggcattttttttttttttttctagttggtaggttttaaattactgattcaatgtcagaactcaatactgttctcttcagggtttcaatttcttcctgactcaatcttaagagattgtgtgtgtattagtcagggttctcttagagggacataactaataagatagatagatagatagatagatagatagatagatagatagatagatagatagatagatacacacacacatacatacatacatagatacatagatagatacatagatataaacgggagtttgttaagtattaacttacatgattacaaggtcccacaataggctgcaagctgaggagcaaggagagccagttcaagttccaaaattgaagaatttggagtctgatggtcgagggcaggaagcatccagcatgggagaaagatgtgggctgggaggctaggcctgtctccctttttcatgattttctgcctgttttatattccctgagagctgattagatggtgcccaccagataagggtggatctgccttccccagcccactgactcaaatgttaatctcttttggcaacaccctcacagacacacccaggattaatgctttgtatccttcaatccaatcaagttcacacttagtattaaccatcacagtgtgtttccaggaattcatccatttcctctagattttctagtttgtgtgcatagaggtgttcataatagtctctgaggatcttttgtgtttctgtgggatcggttgtaatgtcacttttgtcacttctaattgtgcttatttgaacttcttttttgttaatctagctaatggtctatcaatcttgtgtatcctttcaaataaccaatttttagttttgttgattatattaatttctgggtctcaatttcattcagctctgctcttattttagttatttctctttttctgctagctttgaaatgtttgttcttgtttttctagttcctttaggtgtagtattaaatcattaaattgggatctttctaacttcctgcggtaggtatttagcactataaaatttcctcttaacactacttttgctgcatcccagaggttttggtacctgtgcctctgttttcatttatttaaattttttttatttctgccttaatttcattgtttacacaaaagtcattcaggagcaagttgtataatttccatgtaactgtggttttgagtcctttaaggtactgatttctatttttattccactgtggtcttagaatatggttgctatgatttagattttttcaaatttattgaaacttgctttatggctgaacatgtggtcaatcctggagtatgttccaggtgcagatgagaagaatgtatgttctgtggttgatgagtgaagtgttctgtagatgcctattaagtccaattggtcaagtgtttactttaagtccagaatttctttgttcgttttctgcctcagtgatctaatagtgacagtggggtgttgaatttccccactattattgtgtggttgtctaagtcttttcctaggtcttgttttatcaatgtggctactccaatattgggtacatatatatttaggacaattaaatcctcttgttgaattgaatcctctatcattatgtaatgcctttctttgtccttttttactgttgttggtttaaagtttgttttatctgatgtaagaatagcaagccctgctcttttttgttattcattactttgagcctgtaggtgttgttacctgtgagatgggtcacttgaagacagcagatgactgggtcttgttgttttatcaaacttgctactctgtgccctttaagtagactgtttagaccatttacaatcaaggttaatattcacatttgaggttttgaccctatcatgaaattgttagctggtggctttgtagtttctattatgcggttgctttatagggtctgtgggctatgtgcttaaggtgcttttgtggcagcagctgtttccatatttagaacttgatatggtttggatctgtgtccccaaaaactctcatgttaaattgtaatctccagtgttggaagtgggactgggtgggagggaggtgtcacaccacccttccctctcctgcttctgccttgtaagacggctgcccctcctttacctactggcatgagtaaaagttccttgaggcctctccaaaagtagatgctgccatgcttcctgtatagcttgcagaaccataagtcaattgaacttttcttataaattacccagtctcaggtatttcttttcttttttcgagacagagtctcactttgtcacccaggctagagtgcagtggtgcgatcttggctcactgcaacctctgcctcctgggttcaagcaattctcctgcctcagcctcccgagtagctgggattacaggtgtgcaccaccacgcctggctaatttttgtatttttagtagagatggggttttaccatgttggtcaggctggtctcaaactcctgacctcgtgatccgcccacctcggcctcccaaagtgctgggattacaggagtgagccaccatgcctggcctcacgtatttctttacagcaatgcaagagcacactaatacagaacacctttaaggaactcttgtgaggctggtctagtggtaacaaattcccttagtgcttgcttgtctggaaaaaaattttatttcttcttcatttatgaagcttcatttgacaggacatgaaactcttggttgcaatttcttttctttaaaaatgctgaaaatagcccccccaactcactttgcttgtaaagtttctgctgataagtctgctgttggcctgatagggctcctgttgtacaaaatctgacctttttctctagctgcctttaagatatttttctttagcaccgaccttgaacagtttggtgactatatgacttagtgatgttcattttgtatagtatctcacaggtgttctcaggatttcttgtaactggatgtctacctctctagcaagcttagggaaattttctttaattcctcaaatttgttttccaggttgcttatttttttccttctctctcagtaatgccaataatttgtagttttggtcactttacataatcccatatttctcaaagactgtttattttattaaattattttttcttcctttttgtctgactgggttaattcaaaagactgatcttcaagttctgaaattctttcttctacttggtccaaaccattaataaaactttgaattgtatttttaaatttcttaagtgagtttttcaattccagaactggttgatttctttttaagatatttatctcttccttcattccctggatagctttagaagcttctttgtgctgattttcagtcttgtcttggatctcattgagcttccttgcaattcatgctttgaattacttatctgtcatatctgagtttccattttggttaggaaccatttctggaaagcttgtgcaatcctttggtggtgttactacattcagatttttaatggtgccagtaatcttgtgctgattctttctcagctgaagatgctagcacttctaatttttgtaattattttcatgtaggtaggatgtttctttctcttttcttcctctataatgttactgggttttttttccttctctttccctttcccctgcttcctatgggtatgactacagattattttgggtaagatctatttgttttgcttctatctttgctctgcctttggttttgtttctaccagttcttctggtaggttttgtatcaggctgtgcagttcaatctacatgccagtagatgatgcttataggtaagagccagttgcagccaatgtagctggatacttgatccttgtttactggcagaagttctctgttgcctcagacaatgggctgatacatagaatgcatagtggtctgagctccctgctcagccccaagggcatggggccagactggtcaggtccacctaaaggtcccctgatacaggcacaagcaccagcactgacagagaatccaatgggtggctaccaagcacccagaggtatgcctaggcatggagctcctcagtatcaagttctctgcacaggaatgggaaacctcttcagcatcaacttctctacacaggaatgggggatgccctaaactccaaatccagaagagctctgcctaggtgtgtagtatagtgggctccccctgaaccaagatctctgcataaaaggggtagggtgactcgaactgctgaaccaggcaagcaggtgttctgaatacctggagatctgtctgggcatggagcagagagagtccccctatatgaggatctctgcacgggaaggatggagcagctcgggctactgacccaagtaagcttgtgctccaaatgcctgcagacctgcctgggcttagagcagagagggtcccactgtcccacaggaagagttgcgtggctcaggctgctgaaccagataagcaggtgctccaaatgcctggagatctgcctaggtgtaaagcagaaagggcctccctacaccaggatcttttttatccaccagacactgtcgcagaggttgtttgccagtgttctgctcaccaggatctgggtgtccctcacgattccagtggattcccattttccttttgttgttgttgttgttgttgttttttgtttgtttgtttcttttttgagacagagtcttgttctatcaccaggctggagtgcaatggcccgaccttggctcactgcaacctctgcctcccaagttcaagcgattctcctgcctcagcctcctgagtagctgggcctacagagctaatttttctatttttagtagagatggggtttcaccatgttggccaggatggtctcgatctcttgacctcgtgatccacccgcctcagcctcccaaagtgctagattaccaggcgtgagccactgcgcccagccccattttccttcttgaaaaaaagctcatacagtttatcttcatgcactatctagccatttccaagtggctgaggcatgctacaagcctcttatctgccatcttagagaaacaatctgcactttataaatggacaggtaaatctttgttgagagagaaaaaataaaggaaacagcttgtagagtgacccaagtacagtcctgaagctgctctcaaggaaagtaagaaaaatagcagcccaaaccctccccttagaaggaaggcttttcccacagagtctcgccttctggctggaagtcatctctttctgggttttgttgttgttgttgttgttgttgttgtttatttgagacggcgtctcactctgtcacccaggctggagtgcagtggcaccatctcagctcactgcaagctccgcctcctgggttcacaccattctccggcctcagcctcccaagtagctgggactacaggcgcccgccaccacgcctggctaattttttgtatttttagtagagctgggtttcaccgtgttagccaggatggtctcgatctcctgacctcaggatccaccctcctcagcctcccaaagtgctgggattacaagcatgagccaccgcacccagctctctttgttttttttttttaatgttaccttatagtcacagcattttatgctttaatgataattcacatttaattttagaaaacttttattttcttaaagatataatcgtttattatatttacatattgaatgttttcaatgacaataaatataggaaggtcatcaacaagacccatagaatttaaacaatcacacataaaataattggtgtagaagtcaaaattttttaaatggttagctcagaaaatacagaaagctcaagacacattactaaaacatgaactgaccttaacaaagaaaaacactgctttgtttctattatacttcaaaaaaaaacagtaataagaatttaaaaaaaaaatcagttctctgttgcatagaaggagaaatataccattttctctttctgtgaggaaaaagaggaaaatcatatttaaaacgaatgacattctgtacagatgggcataaacagcgccctctgtctcatgtacacacatccttttcttgtcactcagctttatttctggcaattcttaaatcggagaaaaaagttacaataaatctgtaagatccatattgtgtatagaagtaagtgaaaaataagctgttcaaattccaatacctactgatctccttctgtggccaaagtttctctgacatcattctgctgcttgtttattcttccatgctctcctattgttacagagggcaactaattttaaaaagtatttgacagtattaagcaataactttgtgccgattttctttttcacagaacagaattaaatttgagtgcagatgtgagtagatatagaagagtgtatgatatttttgtgtgtgtgttttctttgtagagtccaaaagccctgtggattgttagtgaagctcaggcagaataaagcaaatagaagaacaaggcaactgaagtctaacgatatggtggataagaatccgattttaaatcttgacattgcttgagaatgggaataatgtgttacttatttttcgcactatgactaacaattattaaacatctaatatgtaccaaacacagttctggacatattcccatatcttaactcgtttaatcttgacaacaatccttctgaggtaggttttattacccttcatttcagatgaggaaataaactcacagacattactaatttgggtgactcagacagacacagtttccattttgttcttcctttcagttaacatatatttcttatggactttctgcttgttccaggcactatgcttggcacagcgtctaccatttctctttctactaaaccatatagccggtctctgacacctagcacagtacctaggtcatattaggttctcaatgaagattcactgaattatttggttaatttacttgtctctataaaataaacatttacatagaaatttgggtccaggtttatattatcttaaaacatcttgtaattcaacactgttaaaacatgtattttaaaaatagtttttcaaaagagaaaatatttcattgattatagacatctaggaaacccaagtcaggtggcaaatacctgcactgaaaactaacagaatcatggaaaggaagcctgacacagcatgatgcacattctctcaactttgtatgtaaataaatcctacattctttaattgtctcaagaatgcgtgatttgaatacctaattctattacaaatatcacatgggaatggtcttccaatgttggtacatgtactcaaggcacaatgcatagtgttgaccaaaaagcaaaagcttaccatgaaaaaaggtaagtaatggatggattactttgtagtcagacatggataaggttgaatgttagctctgccatttactagctaccttattttgagggaagttatttcacttttctgaggctgtttctgtactataaaatacagataattctaacagcatctactgtgcactcagagattatggtgaggactaaatgacaggatgtatgtgacctgggcacatacccaggtcagagttagggctcattaacagttagctgtatattgaagtagaaaagttagggaggctgggaaataaattttctggtaggcatgaggtggagcagactacataatgatcaccttctttttactgtctaacctttaaagctccttagtatgcaggaaaatgcctgctcctgaatgagctgatcttcataccagcgtatttatctttcctaattcaaaaacagcctccttaaaacacaaacatactttttcatactgtcattcaaaatagctgcttatgatataacttaatagtaaaaatgggaaaattactgatttctttttgtacaattctatgtaccttcaacaaattatgccttttcattttcaaaggataataccaattccttccaaaggcatgatcaaacctaaatagtggttaatttgaacatttcttttaagtcccagaagaagaaattacgttaaccacttcttcatatcttaagtgaaaaatgtgtaagacagtaactgtcttaaataattacatttctgcttattaggtgtaattaatattttatccccaaattaagccaaaataattccttagatataagatgcctacacaaccaacaaatcaagcttttaatttctgagttctagccaaaaggccatattgcctaagaagagcagaaataaatgtttttttttttgttgcctttttaaaaactttgtaacctacatataaatagaaggaaactcagatttcgaatacagacttctgagggaaatcaaatgaatacaaaatttattgtatactaagcagtaactcttgtttattctatcacttgggactgtatattctttttaaattagtatatcaattgttctgaatataataattcaatacagtcatcttcctaagggtccattttaagcatcattcaaagcaagtagtagtaaaaaggaacaaagcataagccacagcagtgctaaaaatatggtaattgattaaaacaaaaacaattagctgggtgcaatggctcatacctataatcccagcattttgggaagccaaggtaggaggatggcttcagcccagaagttcacgaccagcctgggcaagatggtgagaccctgcatcttagaactgatgaaagacggtaacttttctatattttttcaatatgattttattctcacacatcaacaacattctaagatgtcttacaaagaatagcttttgtaatcccatggcctctaatgcaatacagtgctttatacacattctatgggaattgcaggtaccatctccatagcctaagagtatgcaatctgaaccaaatccttttctgtccacatcttgaagtgcttcttaaattcctaagatctaactagttacttctctattacctgttagtggctctgctatagaagaaaaggtgaaagtaaatatctacaaagaaagacagtggggatagtgacaacaataataaccactatttactaagtgctatgttctaaacactttacatggactttgttacttaatgtttgcaattctatgatgcatacagaatcagtcttattacgagatgaacaaatttagtttccaactgataattgtgaagaaataaaaaactacaggagagtgatttttaaatcaaaggtgcatatgaagagaagcatgctaatgaaataatcctgctagcttttcttttttgattttgtaaaatattaattgctcttgcactgttctttattgacaatggatcagactgaagcttctggtcagtgtatctttattatttttcgagacagggtctttctctgttgaccaggctggagtaccagggtgtgagcatagctcactgtaacctcaaacacctgggctcaagtgatcccacctcagcctcccaagtagctaggatgtgggagtatgccaacatacccagctaatttttgtattttttttttttgtaatagacagggtctcactttcttgtccatgcttgtcttgaactcctgacctcaagcaaacctccctccttggcctctcaaagtgctaggattataggcatgagccactatatccagttctgcttcgttttttttgttgttgttgtttgtttgtcttaagaaaaaattctcattttgtgaagtgtgagccaggagaaagagacaagaggctgactccagaaaaactgcagtcttcattcttaaaaagcacatctttcagggatgatagctattgggatattcacatgtcagcagctctcagtataaacaaaacaacaataaaaagtcagaaaatcagcaagaggaataaacatgtcagaaatattgtgggatccagtgaccatcacatgtcttaataatgagctcatcatccagcctgtatgagccttctcctgtgagagcatctttttgaaccaacggatcaacagaaaatactcccgcagtgcttgctttttaaagtaggattatatgaaagtaactgagaattactcccatctccttatattgacaatcttccagttaatgagaagatggattttctcctcaagctattgggtttgagaatcttctgttctgtgttagctaatctctcatgaatgtttttaacactgaaggtccttgtatttgctattacaaaaaagcaggtgcaactgagttccttccttagaattttgagctcgcaatcatttgttcaagatcccactaatctttttagttcttgtttgctgaacacctgattttaaaagggaaccccacaaatcccctttaaccactcttccatttgagtccatccttcatagtcatctactaaacattttgtttacaatgtatcaaaggttatgattcctaggaagtttggctttctttttttgtaaaaaacagggaaagaactctattgggaatgtcatgccctgtccatccatcccatctttttttaatcgggcaactttatattcatcctaccaggaccaactctaatgtccaaactgcgtgacagaattaacagttccttcctctgtattcctaaagtattttgttcacattattattattagagtattaatatattgagtatagaatgttttggtatgccgatagtgaagtcttattcatctttatatgttccaacggtacctggtacagagtagttactcagtaaaagtatgttgaataattttattaacgtgattccaaatccctaagtgataatcttatttaaggaaaatactataacactgaatactctctgaatagtctctgaaacagtaatgagaaatacaaaaatcagctgggcatggtggtgcacacctgtaatcccagctgctagggaggctgaggcaggagaattgcttaactgggacccgggaggtggaggttgcagtgagccgagattgcaccagtgcactccagccgaaagaaagacagaaagaaagagagaaagagagagagagaagagaaagatagagagagaaagaaagtaatgacagagaaaatactttttcgagtaaaacctcagaaaagaatatgatcccaagtaaaaaaaaaagtaaactgcgaaaataatatttttttccttttcttattcattttccacagcttcttaattctcttccattaaatcttattgaggcaattttatttatggatagttatatctagttttataagcctggcaaatatcttgccccaaagttacagaatatgtatctagtactggataatgcaaaattcactttgaaactttttattagaatatttgcttgcctaattaaagatggaatagagcaatattataataaatgtgcatagcctgaatacaaaggagctaagagataacggaatacatacatacttggccaaagaagacagaccacaattataaatatagcctagatatatacaaagcaaatggtcatgcattaacatattaattgaaggtgatgaactgaagttttatcaattaagaaaacactgcaagctatattctgggcccaattttaaaagtagaaaaaaaatggtattattttatggtttatgttatttatgtttattttatgttatttgattattcccagtccataggcacatccttaaaatttcatatgaacactttggggaaacattttaaagttttcatttgaacttactcctcgtcctcaaatgccagcaaactgttcctggtatatagaaaacagatcttatctaagaattcaccgtttacatgtgaaagcctttgcttagaattcctcctcctctcctgtctgcctgttgaaatcctgtcattctttaagggtcagacattgtgcttatatattgtcagaccacatcttctgagtctctcttgcagccccttcctggattacaactctaaggcagagactgcaccttaggtacgggagcatactgttgcatgctcaacaatatttgatgaattgaaagtaggcttttatcaattcataaacaaaatcaattattttaccaattccagctcatttcaacagatttctattcccaaagtctagggtcctttgtctttgttctgtcaatccctaaagaagcaagatcatttctgtcttttcctatgagcctgagagaggacaggcctcacacattcaccattcccaggtgtgcagtagtgtaaaaataattcacactgattccaaggtatcacttatcaattgggaattgtattgtcagaggcgtgtgaaccagaacaactccatcttgaacaggagctgggtaaaatgaagctgaggcctactgggctgcattcccagacaattaacgcattctaagtcacagcatgagatgggaggtcggcacaagataaaggtcataaagaccttgctgataaaacaggttgtaaagaagccggacaaatcagaccaaaagcaagatgtccatgagagtgacctctggtcgtcctcactgctacactcccaccagccccatgacagtttacaaatgccatggcaacatcaggaagttaccctatatgatctaaaaaggggaggcatgaataatccaccccttgtttagcatatcattaggaaataaccggccaggcgcagtggctcacgcctgtaaacccagcactttgggaggccaaggcaggcagatcacaaggtcaggagatccagaccatcctgaccaatatggtgaccccgtctctactaaaatacacaaaaaaaagacattagccgggcatggtggcacacacctgtagtcccagctacccgggaggctgaggcaggggaatagcttgaacctgggaggcggaggttgcagtcagccaagatctcgccactgcacaccagcctgagtgacagaacgagacaccatcaaaaaaagaaagaaaagagaagaggaaagaaaagaaaagaaaagaaagaaatgggcaaccagcagcccctagggctgctctgtctatggagtagccgttcttttattcctttactttcttaataaacttgctttcactgtgcaccatggactcgccctgaattctttctcgcgccagatccaagagccctcccttggggtcctgcaacactatcactgttaataaaatgatccaaacttcatcaccgttaacccaattaaccctaaagtagctgaagagtaaaaagttacaggttcccattactaaattagaatcagtaaagaataataagcacgtaactgaatctaattaataaataaaatctctcccttttccatcccactaaatgccagtaatcccactgtaatcccaccataccatctaaaatgtatgcttcaaggcccagggttaaggcccaactacatgaagcctcccagtttcctttgttttctctgaaactggctgataccaccctttccagatctcacactttagttagtagatcgactaacaacacagcaagagcctgtgttagtaactcaataaatactgaattgaacggcttctaagttatcactttataagaatgaatataatcttcttaacattatgacactgatattatgttctcatttttgacgttaggaaatggagggtcagaagattagctggtggtgatagaaccacgattagaatccttatctgtccaattcatactttcatactcttcccccatattccagtatgaccctggaatttattctgtcaaatattattgttttctttctgtttctttttttttcttttttttttttgtttttgttgttttgttttgttttgttttttgaggcaggctcttgttctgttgcccaggctacagtgcagtggtgcaatcacagctcaccgcaacctcaacctcccgagcccaagcaatcctcccacctcagccgtaagcagccgggactacaggcacatgccatcttgcctggctcattttaaaaaaaatcttttttgtagagaagctgtcttcctacgttgcccaggctggtctcaaactcttggactcaagtgatattcctgcctcagcctcccaaagtgctgggattccgggcgtgtaccaccacacccagcggtcaagtattattcctgagtgactttgtacatgaggtttaccttcccaagaaccatgttggttcctgaagaatgacctccaacaccagagacagagttttcaaattgaaatggtactcaagttggttaatttgaacagattgtctcttttgctaggtcattctcaattaagtcttggttgaataaattaataacattacgacaaacaaggattaacttcagaccctaccctcttaatccctgaaagaactggacattatagccctacccataggaagacagtgatagaattttctttaaaactatatataacatattatatgaattaacataattatttattcttgctaccatgcatttacatcaaaccattcatttctcaaggcatagatgcatccaaaatcctcctagattgaaactgttttcattttttattgcaataaaatatgcataaaaaatttactatcttaaccatagttaagtatacactttagtgttactaaatccattcataatgttgtgcaccatcaccaccatccatctctgtaactcttttcatcttgcagaactgaaactctaaattcattaaacagtaactccagttccctccttctttctagcctctggcaatcaccattctactttctggctctaagattttgactcctctaagtatctcataaaagtggagtcatatagtatttgtctttaatgtggctggcttatttcacttagcataatgtcctcaaggttcaaccatgttgtagcatgtgtcttcatttccctcctttttaatgctgaatgacattttatgatatgtatgtatgtaccacattttgttttcagataaatgacatgagggttgcttctacattttagtcattgtgaatagtgctgctatgaacactggcatacaaacatctctttgagatcctgctttcaattcttttgggtacatacacataaatggaattgctggatcatacagtaattctatttttaaatttttgagttgccgccatactgtttgccacagtggctatacagttttacacgtccacgcagtgcacaaggcttccaatttccccacatcctccccaacacttattttctggggttttttaaatagcagtcatcctaatttgtgtgaagtggtatctcactgtagttttgatttgcatttccgtcatgattagtgatgctaagcatcttttcatgtgcttattggcgtatcttctttggaaaaatgtctacttaagtcctttgcccattttaaaatcatgttgcttttctattgttgagttcttaattatatattttgatattgatccattatcagatataaggtttgcaaatatcttctcccatactctgggttaccttttaactgttgatactgtcttttgatgcaccaaattttttaaattttcataaagaacaatttgtttattttttttctttagctgcctgttcctttggtgtcattcccaagataccactgacaaatccaatgtcatgaagcttctgccctatgttttctaggagttttatagtttggggtcttacatttaggtctttgatccattttgagttgatttttgtatacaaacttagataaaggtccaacttcattcttttgcatatggatacccagttgtcctggcaccatttgttgaattgactgtgctttctccattgaagggtcttggcacccccatcgaaaatcatttgaccatataggtgaggttttacttctggactttcccgttgattccattggtctatatgtctgtctttatgccagtaacacactgttttggtcacagtagcttcttagcaaattttgaaatcagcacattgagtcatccagctatgttatttttcaagataactttagctatttggagtccctcaagattccatataaattttagatttttttttccttttctgcaaaaaaacatcattgcgattttgatagggaacgcattgaatctgtagaggcctttgggtaggtaatgacatcttaacaatattaaatcttccagttcacaaacatgggatatgtttccacttatttatgttgcctttaatttctttcagcaatgtttttctgcttttcattgttaagtttttaacctccttgttaattcctaagtattttattcttttggatggaattgtttttgtaatttccttttcagattgttcactgtttgtttgtgtataaaaatgcaacggatttttgtgtattcacgttgtgccccaatactttgtttaattcagttattagcattgatagttttttgtgggatctttaggattttctatctacaaggtcatatcatctatgaacagagataattttacctcttcctttccaatttgtgtgccttttatttctttttcttgcctaaatggtctagctagaacttcagtagtatgttgaatagaagtggtgaaaagcaggcatccttatctcatcctcaatcttaaaggaaaagcttttggtctttcaccagtaagatgttagctatgggtttttcatatatggcttttactatgttgaagtagtttctttttattccttatgtgttcagtgatttttgtcatgaaagggtattgaattttgtcaaaatgatttttctgcttcgattcagatgatcacgtggggtttttttccccctacaatctgtttatatgatatattacactgattgattttcacattttgaaccattcttgcagtctgggaataaatgccatttggtcatggtgtataatccttttaatatgctgctaaatttggtttgctagtattctgttgaaaatttttacatcagtgttcataagggatactggtttgtagttttcttttctcataatatctttgtctggctttggtaacagggtaatgttggcctcataataaaagcattaggaagtatttcttcctcttcaatactttggaaaagtttgagaaagattagtatcagcttctctataaatgtttggtagaattcacctgtgaagccctccaagtcagcttttctctgttgagagattattgattactgattcaatctcctaactaggtataggtccattcagattttcataatttttgtctttcacagttttttatatttccagaagtttgtccctttcatctagggtattcaatttgttgtcatacaactcttcctaatgccctcctataatcctttttcattctgtatgattcataataatgtccctgttttctttttttttttttttttcttttttttgggggggggacagagtcttgctctgtttcccaggctggagtgcagaggcacaacctcggctcactacagcctccgcctcccgggttcaagtgattctcctgcctcggcctcctgagcagctgggattacaggtgcccgccaccgtgcccagctaatttttgtatttttggtaaagacggggtttcaccatgttggccagactgatctgaaactcctgacctcaagtgacccacccacctcggcctcccaaagtgctgggattacaggcatgagccaccacgcccggcccagtaatgtccccattgtcattttttattttagcaattggaatcttcttttttcttagtccatctatctacaagtttgacaattttgttaatcttttcaagaacgcagcttttggtttcactaatctttttttttttttttttttttttttaaagacagagtgttggtcttgtcgcccaggtgggagtgcagtggcacgatctcggctcactgcaacctctgcctcccaggttcaagcgattctcctgcctcagcctcctgagtagctggaattactggtgcccactatcacaccctgctaatttttgtatttttagtagagacagggtttcaccatgttggccaggctggtctcgaactcctggcctcgtggtccaccggcctccttaagtgctgggattacaggcgtgaaccactgcgcccggccactaatctctcctattgctttcctattctctatttcagttaacactgttctaatctttattatttccttccttctgctagctttgcatttagttcttctttatctagttatttcactttaaagttaggaaactcactaattttggtattaacttctttatcagatattttagaattagacctatcgatcatgtcatactttcctcagattcataactgcatgatataataatcctgtgtattcgagtcaaaagacacagggactctaaagcaagttcttcatgctctgaaagcatattattctttccttttgtctttatgtgtcctagaagtcattagacacaaaacatggagtttcaaggttactgttagagaacatatcgtgagtctaatggttaattacttccatattatctaagttttacaaacctctgatgtattcttcctttggttttattgttccaagcttcacatctgggcttctcacaatgcctgatttttatagaaagaacacagtcatataataaaaaacactgatgtcagcacactgacattcaacccagtgttttatctggggctctgcttcaggccactgttgctgaatgctgtggactccattctccaagtgcacgtatttgttttgtgctttaaaatagctaaattattatatataactacaacatagaacttttaaaaattctgtaactcaggattttcacaattcaggttgagtccctctatccagtccaaattcatccaaattttactgactagccctcaaacctgagaaatagaaatgcctcctaacagacacaggccgtccgaaggtcaatcaaatcccatgggaatatgacaaaaagcacctttctctgacaagagagagccagtaattaaggtctcagccttgttcccctcatctctgcttggatcagaattcagtttttcaaataatgccctataaatgttaagccaaaaacataggcaacactctaccggggtcagtaccaggacaaagaacatcacattttatggaatctatctttacaatcgtatttttatgcaaaaaaactcaatgactactgtagctgggacacctcacagttgttcctgctacattcattttcatccttttgacttttataggcagattttttttgagaatttttaaaaattatatataaagacatttttaggaaatctgagctggtgtcctcctttcattccttagaaccagacaagaaggcaggaacagtgaagacaaaatacaatgcgcaagagcaggggcaggcaactgttttctgtaaagggcagccttcacaggccaaaccatctctaccgaaactactcagctctgctgctgtaacaatagacaagacatgatacatacaagaacggcatggctcattctggcacccaggcttatagtttgcctgctcctggccaacaacaaagatatggagtctgatgcccaagtttgaatactaactctgttttttactagctgtattaacactggcaagttatttaatgtttctagtggagtctgatgcccatgtttgaatactaactccgttttttactagctgtattaacactggcaggttatttaatgtctctagtggagtctgatgcccatgtttgaatactaactctgtttttcactagccgtgttaacactggcaagttatttaatgtttctagtggagtctgatgcccatgtttgaatactaactgttttttcactagccgtattaacactggcaagttatttaatgcctctagtggagtctgatgcccatgtttgaatactaactctgttttttactagctgtattaacactggcaagttatttaatgtctctagtggagtctgatgcccatgtttgaatactaactctgttttttcactagccgtattaacactggcaagttatttaatgcctctagtggagtctgatgcccatgtttgaatactaactctgttttttactagccgtattaacactggcaagttatttaatgtttctagtggagtctgatgcccatgtttgaatactaactctgtttttcactagtcgtattaacactggcaggttatttaatgtctgtagtggagtctgatgcccatgtttgaatactaactctgtttttcactagtcgtattaacactggcaggttatttaatgtctgtagtggagtctgatgcccaagtttgaatactaactctgtttttcactagtcgtattaacactggcaggttatttaatgtctgtagtggagtctgatgcccatgtttgaatactaactctgttttttactaaccgtattaacactggcaagttatttaatgtttctagtggagtctgatgcccatgtttgaatactaactctgttttttcactagccgtattaacactggcaagttatttaatgcctctagtggagtctgatgcccatgtttgaatactaactccattttttcactacccgtattaacactggcaggttatttaatgtttctagtggagtctgatgcccatgtttgaatactaactctgttttttcactagctgtattaacactggcaggttatttaatgtctgtagtggagtctgatgcccatgtttgaatactaactctgttttttactagccgtattaacactggcaagttatttaatgtttctagtggagtctgatgcccatgtttgaacactaactccattttttcactacccgtattaacactggcaggttatttaatgtttctagtggagtctgatgcccacgtttgaatactaactctgtttttcactagccgtattaacactggcaggttatttaatgtctgtagtggagtctgatgcccatgtttgaatactaactctgttttttcactagccgtattaacactggcaagttacttaatgtttctagtggagtctgatgcccatgtttgaatactaactccgttttttcactagccgtattaacactggcaggttatttaatgtttctagtggagtctgatgcccatgtttgaatactaactccgttttttcactagccgtattaacactggcaggttatttaatgtctctaggtctcagtttcccatctgcaaaatgggggtaatgaaagtactaatctcatatgtctaatatggagatgtacatataagccagtatgtgtaaagtgattagcacatggtaaataatatgtttactacattaatatgtgagcaaatatacattaaaaaggtgttattttgtgaacttgtaaatagttgaaataatgcattcagcttaggcaaccttgtttcaaaaaaaaaaagtgcaaggtttcagaaaagaagatgtacaaatgaccaataagcctatatataaaacgctcaacatcatttatcaaggaaatgccaactaaaaccacaatataacgtccttgcacactgttacaatggctaaaattaaaaagagactacatcaaatgctggtgaaggtgcggagcaactgctgactggaatgcatcatcactttggaaaatagtttggctgtatcttattttaacatgtaaaaacaagcaaacaccaccaccaccaccaccaacaacaacaacaaaaatgctcttatatgacccagcaatctcactactggtatttatccaagggaaataaaccacatgtccacccaaagactcatacatgaatattcacagcagctttattcacaatacctaatcaggggagacaacacagatgttcatcagcaggtgaatggataaacaaattgtgttatcccaatacagaccaccgctcagtaataaagaggaacaaactactgacacaaacgacatggatgaacctcagaatcattatgctaagtgaaaagagtcagaccacagtctataacgtacagttccatttcttcaaaattcaaaacagacaaaagtcatctatagatacaaagcagatcagtggttgctgcagccagacgtgtaggaggattgataccaaagggacatatggcaacttttggggtcacggaaagttctgtatcttcattgccatgataatcatcgtatattatattcatggcatacatatttgttaatacccaaagtatatacttaaagtttatttaaataaaaaggtacaaagaaaacagaaatgaggaagggagtacaactgcaaacagccaactttaaaaggtgagtaaggagctcagcacagaccaaaccaacaactgggattttcaatgcctcaggtcggcctggaggcccacaagtgctgtgaatgtgaaacccaggaacaaatctcctgggttactctcatgtatgtcgatgtccctttccgtctcccctctgtttaagaaaaaaaaaaaagctgagaagacaaactttaagttggcccctcccctaagacacctagctacctccttggggtgtgcaggcctttgtacaatcccctcgccttgccccttatgtatgggcatgatctgtgacttgcttctaacagaatatggcaaaggtatatgtcactcctgccaattacatttcataaaactccatcttgccatcagatcttcactagaagctcttcttgctgacttaataaagtacatggtcatgtggggaaagccctacctgagaaggaactgtgggtggtctccaggaactgtgggtagacttcagccaagagccggcaagaagccagggccctgagtcctactgatgcaaggagataaattctttcagtggcccaagcgagctgggaagtggcttcttccccggatttccatacgagaacacagcccagctgacaccttgacgagagctttatgagaccctacatggaggatccaggtgtgtgtggacacctgacccacagaaaccatacgattaaaaaatatatgctgctttaggccacaaagtatgtgataattcattatacaaaataaaaaatataaacagaggagaagatacctaaatggttaaaaagaaaaaacaatacacccaataaagtcggcattttcagaacacaagcgctaggcagagctgcctgactgttgtcaggatcatgcagcaacttctttaacaagtcatgctgccctgtgttccttcctgacaccatgacaggagcaaccactcaagtccagcatcctctaggccctaaagtgctactacatgtgactcacagacttcacaacagttctaagagcactggagaacagtacctactgtcctttaaagccagggccttactcccttctgtggagacacacaccccttggctctaagtggccccagtggacatgacacaacaatcccaaagagccacttaagctacaatgtaagattgttgagaccagccgggcgcggtggctcacacctgtaatcccagcactctgggaggctgaggcgggtggatcacctgaggtcaggagttccagaccagcctggccaacatggcgaaaccccatctctactaaaaacacaaaaattagctgggcatggtggcgcgtgcctgtaatcccagctacttgggaggctgaggcaggagaatcacttgaacccgggaggcggaggttgcaatgagccaagatcatgtcattgcactccagcctggcgacagagtaagactccttctcaaaacaaaaacaaaaacaaaaaaaaagattgttgagaccaatggttatgtgcatggggttctactctacagctaaagaggaagtgggatgcaagacaaaggcagttatttaacctctataacatatttagcaggaagctcaaatatgcagactattgaacagggaagaatagagtagggagagaaaagacgatagtgtagtaccatggggaagaacagtccaagaagtgtgaattgctctgccagggacagccctgcctgtgacgcatcacacaacttctctataaaacaaggctttatgatccttaaggcgtcttccaggtctaagagtctatcattctacattatataaaaatctttagttgaacaattatagtatcttggggggaaagtgtactaaggcatcaagaaaacaattttatctgctaagagtacttactcgtagtaagtaagattagtatgcagaattctgagtttagcacacacgatgttcttaggatttgggagcctagtcttataaatgtgaatgccatacattaggttgcaaagaaaaggccattcatatccacgaagataacaaaggaatatatatagtagcatgaggtgattttatttaaagtttaatgtcctcaagtaatcattccatgctcagtttcttataactgtaacttggaaatattgacatttcatatgcaagctataactaaaactaacttttctttataaccagctaggaaaaaaataggcacaaagtattattttataaagtctaccaagtaacgaacatcaaagaaatgcacatgatatagtcaggctttttctagcacttgtcagtacaagccagttagtggagtaaatcggtttggctgaaagtcctatgctgccatgcgacagaaaagagagctaaactatccacattccatagtttaccttctgtcactaataatctccatcatctacttaaaaatcttagagaagctgggcacagtagctacttgggaggctgaggcaggaggattgcttgagcccaggcgttcgagtccagccagtgcaacacagtgaaatctccatttctctctttaaaagaatgttaaagacatctacctcaatttttggcaatctcctactgtagcttgaaatgttaaagcttacatttagactgtgcatgtcagtttctattatcattccactttacagagaattaaaaaaacactgtgcttgcaacttaaactggtattaaactgacccctgctggcctcatcttttctgtttctgcatttatcagatgcttcaagagctaactgcattctatagttcaacctatatttgatcaggctgccacctcaaaaacaaaacgtgggacaaagatggctagttgtaccaaattccaaatggaaggatgccttcctcagacctttgtctattttatttgcaaaaacctagcaattaaaatcacactaatattccaaagaagtatctcctatagcctatgaatttattctaaaacctaatgcactcaatagacatttacagatttctcaaagactgccgggaaataaagatttttctaatcacagcacctgccctccaggtacttacaggcatttatgagtcattgaaaagatacatctgagaattcaattctagcatatcattggacaccacacaggtgagaaggaagtggggtccccattcagcccgtggtagagcctgcctcactggtgccaggtcacttgagattcgttactgaaatggcccaggacaatgtgttctcttccttctttgtgaactcactgtgctttatgaattataatggctgccattgattggcaacctactatgtgccagagactactacagttaggtgctttccacacactatcacatttaccctactcagtaactctgtgagataggtgattttatgctcaagcttgtatcatgggtgagtaaagctctgtgagaatactgatcatatcataccgcaatgtttttcctttaaagagatgtttctcctctaaacaacagcaaacaccttaagcacaggaaattacgttattgtcatctctgtatcctcagaacctcatatacctcagtaaaggcacatagtaggcactctaaaaacatctgcaaaacatacaaatgaaaatattattgaaagaatgtagctactaaatacatactatgggcataacctatgcttaggcactgagaaaacagtggaggaaaagaaagaagaggcaaaggctttgattcctgagcacagacacccatacgtgactatggaaagaaaaggagaagttccaagacataagtaaacagaatgctatgtcaatacagctcatactaccagtcagctcaaaatcaaacagaaaaaggactcctaaatcagaggacaatgacacactggtgctgggctattggaaatgaaacctattaaagaggaaaaaagagagaggaggtagaatgtcattaaattcctttctgtttttgtaacatatctacaagaccaaatgatgtgaaaaatagttctgcaagacggggactatgtgaatccagttttaaaggtccaaatatgtatactttacttatatagatcatggcatagtaggaaagacagaagatcataaaaacaaatataatgtagaggtctaaaaattgtttcctggtcaggtgcagtggttcatgcccgtaatcctagcactttgggaggccaagccaggaggactgcttgagcccaggagtttgagaccagcctgggcaacatggcaagaccctcatctctacaaaaaaaaaaaaaaaaaaaaaaaaaaaaaaaaaaagcaaaaaaattagctgggggtggtgttgcccacctgtaggcccagctactcaaaaggctgagatggaaggatcgcttgatcccaggaggtcggggctgcagtgagctgtgggccaaggtggcgtcactgtgctgcagcctaggcaacagggcaagaccctgtctcaaaaaaattaataataattttaaaaaataaaattatttgttccaaaaaaaaaaagctgcatgtatttttcttttcttttgcttacctatcattatttttccacatctcttttcttggtacttcagacagatgaagataaatgaagcacagtagttaacttctttgtttggatacaaaaaatcttctgtatcaacaatattgttatgcaagcactttaaatgttgcttctagcagatgagacttctgcttcaacatatgttatggggaaaaatgataaaaatttattcatgactagaataactgaacagtcaacaaaatctaactagaaaatgtaataaatcaacctggtttgttgcagttgttaattatctaaagtaaactgaagatccagtctctcactccaaacaagaataaataatcccagattctcagcactgtcaatactttctatatcatcctaccactgctgcaaacttcttccttcagagtgatcggaatttaacttcctctgcctgcaccttccctgagacaggaaaagccacaaaagaaataaggagctctaaaggttcttctgctcaacaatggcaccttaaaaatctaaaacttactgagggagcatgtaaccccccatagaaaataaaacagtggtcaagcttttgggatctggactcagggtggcttgggttcacaccacagttctacaaatgtaatcttgggcatgtcatctactttcctaagccagagataataacattgccaagagtgtaacagtgagtgatcatatgcacagagcttagcattttacctggaacctatgtgtttcatgagcatgagctattgccattattacatcccctttgctacatccctcccaaagtcctaccatcgactcgcaatctgaacaaagagaaaggacctcaaaatccttactctggctaaactgggctttaaatgtgtcagatgtgtccatcttgctttccttcctcaccacccctgcctgccaataatcagagccatggaaaagcttcccttgctcatgcataaataacgtcctcattcatatatacctgtgtatgtttaattacagtaactagaggtctcaaaataactcatatggttctaatttcaaatatttaaagctcttaatgacacttgcttctgtgagaccagaagaaatataattgccacagcgataacatctaaagcccaagatcatttctcccagaacttatagcactcacagaaatcgaccaggatctgcttgcagtatcttttagaatttctgtctcccactgacacaaccgagtcataaacaaaaactgcagcacttgccagctttcacagcccatgacaactgtgagttacacacaaccttcaggtacaccattcaccctaataactgatttcaaaataacaaaaggaagtcaagcatttaaatgtagcacattaatatttgactaaaatagcatatcaaccagtagaaaaatcaaacaaggtaaattactcatgaaagaagaactacatgaatttctcagaaacgaagtcttgctggagaggtacatgccatgtcacttgcaaccaaaagtacttcctcagagccaatatcaaaagcaccggtgagtatgctgcaaaacggcatagcaggctgtcagatgctgcatatcagctacttgagcagttagattaagctttcccaacaggcaagtgctgcagtacttctgcatctagcatctggtaatgtgttgcaaacgcagaacaaagaaagcagcaggctccgaaatctttcagctttcctttgaccatctgcagcacttaaacacttcagggttaccaggtcagcaacgtgaattctctcaataccatgaaacatgagcaaaatttccattctctgaggtttctaattcttttctttttcttttttttttttttgagacggagtctcactctttcgcccagaccagactgcagtggcttgatctcggctcactgcaagctccgcctcctgggttcacgccattctcctgcctcagcctcctgagtagctgggactacaggcacccgccaccacacccggctaattttttgtatttttagtagagacggggtttcaccatgttagccaagatggtctcgatctcctgacctcgtgatccgcccacctcagcctcccaaagtgctgggattacaggcatgagccaccgcgcccagcctctaattcttttatttttctttactttttctgattgtattgagataatcaaatgatttttctccttaagggagtatggtaaattgtattaataggtttctaatgtgaaaccagccttacattattggaagaaaacacaatctggtcatgttgcttttaaattatttgctggattcaggttgctaatattttatttaggattttaaaaactcatgtttactagtgatattgactagtaactgcctttccttttttttttttatttccataggtttttggggaacaggtggtatttggttacatgagtaagttctttagcggtgatttgcgagattttgatgcacccatcacccgagcaatatacactgaaccgaatttgtggtcttttatccctcacctccctccaccctgtcccccaggtccccaaagtccattgtattattcttatgcctttgcaccctcatagcttagctctcacttatgagtgagaacacacaatgtttggttttccattcctcagttacttcacttagaacaacagtctccagttgcatccaggttgctgcaaatgccattaattcattcctttctatggctgagtaatattccatcatgtatatataccacaatttctttatccactcattgactgatgggcatttgggctggttccatatttttgcaattgtgaactctgctggtacaaacatgcgagtgcaagccacatgcaggagaataactggatcctcacctctcaccttatacaaaaatcaactcaagatggattaaggacttaaatctaagacctgaaactataaaaatgctacaaaaaaaaaaattggaaaaacccttctagacactggcttaggcaaagacttcatgaccaagaacccaaaagcaaatgcaacaaaaacaaagataaatagatgggacttaattaaattaaagagttttggcatggcaaaaggaacagtcagcagagtaaacagacaacccacagaatgggagaaaatcttcacaatctatacatccaacaaaggactaatatccagaatctacaagaaactcaaacaaattagcaagaaaaaaacaatctcaccaaaaagtgggctaaggatacgaatagacaattctcaaaagaagatataaatggccagcaaacatatgaaaaaatgcacaacctcactaatgatcagggaaacaaaaatcaaaatcacaatgcaataccacctttctcccgcaagaatggccataaccaaaaaaatttaaaaaaaatagaagttggcatggatgctgtgaaaagggaacacttctacactgctggtgggaatgtaaaccagtacaaccactatggaaaacagtgtggagattccttaaagaactaaagtagaactaccatccagcaatcccactactcggtatctacccagaggaaaagaagtcattatatgagaaagacacttgaggtttctgattctaaagtaaaacctccatcccacaaaaagcttaataaaggataataacaaaaccttgctttgccagcacttttgtttaaatttttgtttttaagttccaggatacatgcgcaggatgtgcagatttgttacataggtaaacacagcactttttttttaatctgacaaatcacaaatcaccacacagctcccatcaatgcctcttaaaaacaaatattttccactgtcttagggaagtcccaatttctttaaaattcatcatacaaattatttcctcaagttttcactcaatgaaaattcctgagtataacacaagactgacattagttctgtactcaaactctcagaaaattagtgctagttttctacagactccctgaaggtctttttaaaaatttttagaaatttgtatgtagtaatgacttgccaatataaatgtaatacagagacactgtttttgttcatctttgtatatccacctagtatagggcatggcacataccagacactcaatatttattaactaaagagtacgtaggtctgctgcctctcaaatatttgataatcagacttttgaattctaaatttcaagtggagaaattttctccattgaccatcattataaaactgtagtggtatatctttggaaaatatatgacctcaagatataataaaaaaatctttttttttgtttttttttttgagacagtcttgctctatcatccatgttggagtgcagtgacggaatctcggctattgcaacctccgccccctaggttcaagcagttctcatgtctcagcctcccgagtagctgggattacagttgtgcgccaccaggaccggctaattttttgtatttttagtaaagacagggtttcaccatgttggccaggctggtcttgatcccctggcatcaaatgatccacttgcctcggcctcccaaagtgcaaggattataggcgtgagccacagtgcccagcctaaaataacattttaaaaaacaacaatcattttagaatttcatgaatatcaattgatcagaaaacattagtgaaagtccagagttgttttaaacttagaaaatattttctaatatatatagttttcggaataataattaggtcaatgagctaaagatttccttttacagtttcattacaaatttaaaaagcttttgtagtaaaaacccatgaatgtaatcactatttaatagtttatgttttctaaaaatgtgtttggcattccatctgttaagttaggactccagaagaacttaccgctatgtccaaactgggttggagggggacaagctgggtttaaattgcgtttctttcacttgctaggtgaccttgggcaagtcatactaaacctcactttgcctattaccacatctctaagatggacatagaaataccaagttttgggaatactattcttgaagtatagtaattagatttgggggggttttgtgtggttccttacacctgaccctgtctctgttttggccaggggcatccatctgcctacgggatattcaggtttatggaaacaggaatacaaagagaaagactcagtgttcaattatgacacctataaatcaatattttcagtcaacaagcaaaattcttgacagccaagctttgtcaagagaaaatgtgctttctaaattcctaaaacactaatttttaaaatgagggctgaaaacggaatgagaagctcaccttgcttccatgagcacagctgcagggtagaaccacctaggaaggccttggaacgttacacggcctggggcccccacccccagacacttagattggtctgggctcaggaactcaagcattggcaagtttttgaaatgccatcaggtaattctttttttttttttttttttttttttttttgagatggagtttcactctgtcacccaggctggagtacagtggtgcaatctcagctcactgcaacctccacctcccaagttcaagcgattcttctgcctcagcctcctaagtagctggaattacaggtgtgtaccaccacgcctggctaattgttgtattttcagtagagacggggtttcaccatgttggtcaggctggtcttgaactccgccatcaggtaattcaaatgtgcagcctggatttagaaccgtagctccacagagaagcttctggtttggttcaaaactacgatccacacacaacaggagggaaaacccagaagtggcctcctggtcccctacagccccatgcgtatgttatgcagtggatcctgagctttcctgtgacccagtgggggtaatgcagagactaagactccccagagtggagagatggcaagaataaaagctaaggctagtccaggcacaagactagataaaccaaccacctggggcagaagagaatcaggaccagtctgcagtcttgctcccattgccatggaaggacaaggaggggaaaatgcaaagaattgagcatttatctgaaaaaaagacaagctacccaaggactttaaactacaagaaacagaagcaccattaaggggtaagtttgtccaatcatgtacattccttacttaactgcttccccagatgggctgaggtaagaaaatgtagttcaattataaaatatttaaaagcctggccaggcacggtgactcacgcctgtaatcccagcactttgggagactgagttgtgtggatcacctgaaggtcaggaacttgagaccagcttggccaacatggtgaaaccctgtctctactaaaaatacaaaaaattagctgggtgtggtggcgggcacctgtaatcccagctacttgggagggtgaggcaggagaatcgcttgaacccaggaggcggaggttgcagtgagccaagattgcgccactgcactccagcctgggcaacaaaagcaaaacttcgtctcaaaagaaaataataatcttaaaaagcgattgttaattaaaattatccaaaacatgaaaaaagaaaaagattagggagctgtgtggccttctcatattactctagagcactgtttcacagcttcacccaaggattatttaattccctagaagaatgccaatgcatttgactttgttacttgctgttagagcacagatagtgtgaaactacaacgttagcttatagatttctgtccagcagaaaggataactctaaaaactgtggttttagtgcatgcagaacgtcaccagttttgtctccaatctagcaatcttattctaatgcctaaagatcagttccttcagtactctggacctgcattaactctgcctggtttcctcattaataagttaatacatctttggcatttcgttttgtatttctgtgagagtcaggttttaacttttcaaaaaatttactttgatagtatattttctttgcatgactggtagtgtatgtaaatctaccactcactgacactgatctcagtggacattttataagataattcgactgcttggtgcagtgcatggcacttggtaaatgctcagtaaatgttactgttcgtgggtgctagtggctagaggagattttacctgcatctaacagtaaccatgaactcaccaatggaggtccacaaccataatccagggcaaccccgggtaagtggatacacagacttcctcagtagggactattcccatatatcataaatatagggagccactctgctcaaaataattcccaaactatcaacacagacagtacgactcacttgtatatatttatcacgagtgtgtgggcctgtgaggaaaaaactatcataacttagcaaaatcagaaagtacacagatctaaaagaagccatctccttggcgaccaaaagtatgctgctccatacttaaaggaatcttcaaatgatgttcaaatatatgatgacaggagaaacagcaacacagcaaaataactacattagcatatgaagagaggaaattggactggggaagacctgagagttttccagcaaaaactggagaaaagggaactaaaccatctacattccatagttcatcttctgtcactaatagtgattattatccactaaactatctaaacttttggccaatttctactgtcgcttgaaattttaaaagcttctttttggactgttcatttcagttactgttctcatttcactagacaagagaagccctgaaaaccctagtaaagctatcagggaagagatatatggttaatttcttaaattatgaactccttaagtatgacttctctacaaaaagtttcttcatcaatgaagtgcacctgtaaaaaccattccttgtctaaccttgaaattggcctgtaacttcaaggcttaactttcgagtgtgagagtttcagacacatcaacatattttcaaggccataaacactgggtaatttttcatgctcaagtgtctggagtttcgttttcctaatatcaataagcaatatcacaactagcaaggcagaaggaataaaagcacctcagcctctcacaatgaactgaaaaaccctatattctttccttttttttccttcacatcccatttcttttaccttgcccagctggtggaaaaaaatctagcttccttctgaactaaacacacataattaaatacacacaatcttaatttaccacactgatgtcttcatcatcagctaccctagcaccatttcaaagcagcagaaagaaatataataatttataagccagctcctgaggttatatatttattttaaaacatgccagtttcaacaatataaaatgctttcccatgtttaaaaaacaagactatttgttaccttgtgatgggacaattaaacaagcttttaagcgtgataaaaaaaaaaatacataggttaataaagtagtcttgataaaaacaaagcaaagatttgaaaacattggtatttccataacctacagaatactgatgactagatggtcaagacaagcatcagttacaaattatgtatacagcttgctaacaaattagggaaacgttcccctctggtttctttcccgactacttgtaaaataatattcgcatacaaatttgcaattcaaatttgatgtcttatgagtgcattttgcagatcatgctctgagaaggaagagagtgagctaagagttgcatggaaagtataatttgctgctggcttttagccagaaacactagaccaaatgtttatggagaccacgaggcacctaagcaagcccagtgcatctggacttctcaatactagttgttgctatttatttatatgttaacctccaaataaaaggtcaaatagagtaatatctacattacacattcatacattttaaaatatatttattttacttacacagtacaggaaaggaagtgatttgccgtcactttgagaacacttgcaatagcaatgacaagaaaaaccagtaatttaagcaacactaataaccatatgtctggacctatgttcaactgtaatttacacattaagtataagcttttattttcatacttgagaaaacatgccaggtattcagtatttataatcatagttaacttgcagaatgaggaagctaattacagtagaaagaagaaaatattagccttgggaaaatatgaatttgacgatcacacaggtaggtagtaaaggagccatttctacctcccatgaccaatgcaatacaccagcatcttagacttactatccaacacaccagcatcttagacttactatccaatacaccagcatcttagacttactatccaacacaccagcatcttagacttactatccaacacaccagcatcttagacttactatccaacacaccagtaccttagacttactatccaacacaccagtacattagacttactatccaacacaccagcatcttagacttactatccaacacacaagcatcttagacttactatccaacacaccagcatcttagacttactatccaacacaccagcatcttagacttactatccaacacaccagcatcttagacttactatccaacacaccagcatcttagacttactatccaaaacaccagtgccttagacttactatccaacacaccagtaccttagacttactatccaacacaccagcatcttagacttactatccaatacaccagtacattagacttactatccaacacaccagcatcttagacttactatcctacacaccagcatcttagacttactatccaacacaccagtaccttagacttactatccaacacaccagcatcttagacttactatccaatacaccagtaccttagacttactatccaatacaccagtatcttagacttactatcactgtcaagtattaaagcagatatgatcactatatggataaatatattgctaataaaaatccactccaacataccagtcactccagcacagcacaatataaattttgtagggatatgctgcagtaaaccatgtgacacagtaaaaggaatgacacattacaagcttcccttaaacagaagaccatgaacacgtattgccaacctattacttgagagcatttgggggcaaaagagtcatgctgaaattggagtctctgcaaaaggaacacaaagggctgagcaaacaacaggaagcttaggcagggagcatggcagacactgaaaaaacataaggaaagggtcaacatatagccatgttcaagaacataattttagttaatgctaagtattaagactgaaaactgaaacatgggttgggaaaaattgctgatgaaatcaaggaagatcacaaagaatcattccaaaccaccatatttggtgggtaaatgtatctgtactgtaaaaacactgtaccataaaaaacaacaactagatcatgtatgatgctattccatacatggtggtaattatgaggccaatttgcatctcctcaccgagaaaggattgtgaatccccaaactacatcatatcaccccctaaagaatgttatgggtccctgacctagtggatgatctctccctctctccatgaggccccagcactgacagatatcttctgaactatatttggtcatgtagtctgaacaacaaatcattcgcttgctacctcatctacatgtattatgtacttggatgttttgctggcaccctagagatctggagcttttagaaggctactttaccataggtgtggtaagtgtgatcaatatatacctttaattaaactgtaacttattttaagccagtatcagaaggcaagttaaaaaattagaggactgtaacttctaagtagtataacacgcacattagcattcacccacgtgcttccacttttgcagacatggagcaaaagcagccctcctgctagtgagactactccaagaaaacccctcccccggcacagtggaaaaacccacgacagtctcagaagaagagcgtctatcccaggattcaaggttaattcctttgctctcaccttctcagaaatatcacttcatcattaataacccttttgcccacttatctttaaatcttcatctttgctggctcacacattcaaatctcttcaaaacaaaaaaacagaaccaaaaactccacactcctaattagtgccctattcttttcttctattcacagtcaggtttctcaaaatgatcaagcactcatgactctaaggtgctctagcaaagctcaccaaaggattccctattattgaactcaatgaaccttttcagtcctcacgttaactgacgtctctgcagcacttgaagctgttgacctccatgaagtgctttttctcccttggtttctatgatatctttctctccaggttttcctcccactttactccctctcagtcgcctttgctggcttctctttttcagcttgccccttaaatgttcctgttccaaagtgttccatccatgctgctcctattttcttttctacctaccctctccctacattccttccacctccacagcattagccatcatctgtatactctagagaatgtcttcctcatttctaaataccggcgtccccagcacatagcactcactcagtaaggtcagatgaaagcctgatgaatgatagacaattacagaagcaaccagggcccactatgttgcagagttagctttagcaaattctaatttcttgaccagattaaatctatctacaaatggtcagtcttactgagggctgactaccattgcctgtaagtgttcagctaagtgttcatttagtcaacaaatatgcagtgcctgctatgtgtcagcacagtgcctactatgtgccagctacatgataggccaaagaattcgtggagaaagccctgaaaatagaaacagacaactctttctgagtccatgtatacatctgtgtgtgatctgggcaaaccaattaagcttcctttttttttttaagacagagtcttactctgttgcccatgttggcgtgcagtggtgcaatctcggctcactgcaacctccacctcccaggttcacatgattctcctgcctcagtctcccaagtaactggaattacaggcacccaccacctcgcccagctaatttttgtatttttagtagagacatggtttcaccatgttggccaagctggtctggaactcctgacctcaagtgatctgcccacctcagcctcccaaagtgttgggattacaggcatgagccatcgtgcccgacccaattagcctttctgcctacaaatgtcttcatatataaggtgagaataatatatctattttacagggttactgtggaggttacatgagataatacataaatctaatatgttgcatattacttatgtctgttattcactgtgaataatatgtaataataaatattttatgtactcctttgttaaaacaagcttataagacaagttaaggcaggaattagtattcccactcagaatactaattctattagtattctaatagcagcaccagaacctaagcaatctccccaagcccactcacgcagtccctaggtggtaacgttctttagtgtcagagaccaaactgtgattctctttacttagtatctcttacagatcccactgctgcccagcagcataaaagatcctacccagaaaagggtctacagttgagaagccaaaggtcctaagatagtagccgaggagttgatgagcaaacaaagtgtttgttttcttaataaagaaaaacagttttctgcttggacacagtgtaattccaactataagaggcagcataatgttttcagtcagggaaaggtctccaatttcataagttttgatttaacaagaagattctaatattaaaaactgtcaggttgccacggtaacaatctatttgcaatcaagatgctggtggtattctgttatatttctctcaaggaaaaagtaaactagatgtagccaaggaatttaataaaagtatctgttggaccaaaaccaagatatgactgtttttaggcaatatgacaggatttaaatatacagcaagagaccctcaggttacaataccagttccatcaataaaattaaaagattttgaccttgacaccagtacaagctatagccatatgatctggaaatctgaatcctctgagcaagaaaaataaatcgttaaacaattgagatgacaggcatgggacaagaaagtcaaaattcatcagaaggagaacaaaatcaatccccaagggaggtatgaattataaagactaaatttctcacagaaaattcaaaggtttgatttgggtgttttgttctgctgttgtatgtatgcatgtatgcatgcggaggtaggttttgcactccaggacattcttggatgtttttaacttgctgctttcatctagaaaatgttagaaggacatattgaaaatgaactgattctagacaggagaggaaggaagtgactgtcaggaattaggccgctctgagtctggacatgcagactatgcagacagagaaacttcctccacaaccaccgaagcctcagtcacgcccatgaaaatcacatggattttctctacagttaagacttttcaagtacttgtttctacaacgattcaagaaatggtaacacttgcccccacaactttagccatgaacaactcatttctcttcaatgtgttaataactttacagaactgtatatgcatgctgaatgtctagaatgacaaccagaataaaaactgcaactcctttggcttcgacaataaattggcttcacaagaaaatacctacattcatgacagaagaaactggctcttgccttaacctatatagttaatgcagatttatatataaataacattatatactttttagaacatatatttttataaatgtatatttatatacaaaataactaaattattttctgaaacagccttgaacattgtgtgtaatctcattttctgtaagtcattttccttctactttctctataaaattggagcactgtcctctacccctccgaaaagacatttgttaaaatcacagtgaaggttcagcataccttagaaaatcagacattttaaattctatgaagttcagacaaaatattaatacaatatgatattcctatttaaataaactcctatttaagtgattaatgaatcatttatgtattattgtactatacttagtacagataacatatttttgttgagatagcgttcttaaagatcacagagattctgaaaatgcttctaggttgaggaacttaggtagaggaagctaacaatcgatgaatacaataaaggaaactcatgagtgatagagatttgaggaaagtgctagataatcatccagactttaaatagtttgggcaatgattcagggacataaatggccagcagttagaaatagagttggaactcaggagggggctctgacacagagacaaaaatttactcattcacaattaagtaatagttgaatctatttagaaaaacaatgtgaaaaagaaagtaagaaagagaaacaaggaccatctttgagagatgccaacatttaaagatccatggaggtgaaacaaacaaggtgacagaggtatcttcaaagtcataaaagaggagtttcattaaggaaacagtcaacaatatatgcctcagaggagtcaaacaggacacagaaagagaacaaaatactgtattcaacatttaggatgtaactagttacgtgagtgaattcacttcagtacggtagtagaggcagcagctagcctacaatgggttaatgagttagcagggaaacaacgcatccaagaatttgtcttatattctaagatcaagaaccctcaacgaacaaaggtaagtgattcaggcttacatcataacccttcctaagttaaaaggacaagagcatttgttcaataaggacagaacctgaaattactggcttgtaatgaaaacgtttttaaccctaaacaagaataaatttcttgactagaatatttttctgatgcatcaaatgtcaaatattcaattattctgatgtataaataccagagattcactgtattgaccagagaatgctatgaatctacccaagattcacaatacttttcaattaaattaagcaatttttccttctaagacttccatttcagttctaaatatgtgttatctccattcatccttgtctcataggacaatgatcttcatattttagaggtagacagctttactctttggtttctgttaacaggacatcttgaatttaattgccaatgttatttatgaattataactgtaagagtgcttttcagtatgatgaatattccatcatctttaatttttatgagatgcttaaaatgaagggggatgggacagtctagctgctcttttcctctcttgctacaccctcttctggaaagacaataaacaacataagctttttcctttgtctatataaacctgcaggttcacagacagtgccacttgtcaacagctaaagagaaataagaaaagaacttcagaaggggaaacattcataaagagcaagagcacactgaggtaaaaaaataataataataaatagaagctattacagcaggaaaaaaagaataaaacataagtgcatactaatatcaagaactacaaaggtggcaaattgaaataatctaaatactgaatattaatttttttctatgaccaaaatcatattaaagcttacaaacccaacctaatgcctaatgaactcatttaagttcaaagtacatgaatgtaaaagaaagctgaatataaagaggctatcttgtgttttcaatacaatttaagtgttattataggagctgccacatttgttcccaagtatcccttcataaaatatcagagacaagatggaggttttgtactaataaagtaaaaggtatacttccaccaggtaaaaactttctggacctaacagctttaaaaataagattgtaccaaaagctatctttatataatgatgatgactggaccatcaagaatatgcaacactccctgtatattatacttcatcatataaagaaggaacagctctacttttaaaagccagagaaaatgtctaggtctgcctagaactgtcatggccttaaaaatttcatggggaaaaaaaagagtcaaagtctcatggttttattatgcaaaacttcatgatttcaaacccaccagaatcaaataactaaaaaatgaaaatgaaaattacaaagaggcattacttatatcacttttaagattggcaaggatgaaaaagagtaacagtatcccgtactagcaaggctgtgagtaagcaagcagtgttcttgtatagggttggtggagtgtaaatgcaatatatattagagcacaacctggcaacatatataaaaatgtaaaatctgtttctgcaacttcatttctactaatttatcctatgtaaaaaccagtttcatatgcaaagatagatgtatactgatgttccctacagtggaaaaaaatggaaatacttcaatagcgtactggttcattaaattttaatgttacatgcagccaacaagtgtatgaaaaaaagctcaacatcactgatcattagagaaatgcaaagcaaaaccacaaagagataccatctcatagcagtcagaatggctattattaaaaactcaaaaaataacatgttggtgaggttgcagagaaaaaggaacgcttacaaactgttggtcggagtgtaggttagttcaaccattgtggaaaacagtgtggcgattcatcaaagacccacaaacagagccaccatttgacccagcaatcccattactgacacatacccaaaggaatataaatcatttatcatgaagacacatgcacatctatgttcatcgcagcactattcacaatagaaaaagcatggacaccctaaatgcccatcaatggtagactgaatttttaaaatgtggtacatatgcactggggaatactaagcagccataaaaaaggagatggtatcctttgcaagaacatggatggaactggaggtcattatccttagtaaactaacatagaatagaaaaccaaacaccgcatgttctcacttgtaagggagggctacataatgagaacacatggacacacggagaggaacaacagacactggggcgcacttgaaggtggaggatgggaggagggagaggatcaggaaaaacgactactgggtactaggctgaaaaatgactactaggtactaggcttaacacctggtgacaaaataatctgtacgacaaaccctcatgatacgagtttacctataaaacagtcctgcacatgtacccctgaacttaaaattaaagtttaaaaaaaaaaaaagttaacaaagtttaacatgttcatacaatggaatagtatacaaccattaaaaaattatacgtggtatgcatgtagctgtgtatatactaaataaagatataaatgtggacccaactgttaacagtgttggtctctaagaagtaaggtttctagggtacttggatttctcatttgtgcttttacttactttaacttttcataatgcacatagtttttttatagaccccaataaacatttcaaatgagtgataaaatgtattagcacagttgaaaatgcacatttgcatgtattatagacaatggcttttgttgtgttgaaggatcaaggggacttagatgtattaaaggtaatgtgatggctgtctatagtctgctgttgttattaccaaagagatttctaaaatacccaaaattgccttcttaggtgtacgggtgaggaaagcggccagcaatgtttaaagtattacctgaatgagaatgctattgatctttgtggtggtgtgggacgccaaggtatgaatctggaattttcaaatgcctctgtgctttccaggtactaaaaacatgaactctaaaattacagacacctaggttaaggatcagttctaccactgactagctatgtggctctgggcaagttccttcatcttcctaggcctcagtcttgtctcctggaatacagggataataatagtacgtacccccatagaactgttgtgaagatttaaaatataatatatgcaagccacagtgcctggaatacagccagtattcaatgttggctcttatccttctcaaagcacatcaagtttgctttttcattactgattacaaagacctcaggaaatcaaagtctggattttattgcaagcaaaatagaaacaagggatattaacttcagatcagataatagaaaacacccagcctgtcagtgaagttcattttctttctagaataatgctacccgtcctaagggtagttcagctttgtagagatagaagtcgtcactgattatcaataccaaccctctgactgtgtgaaaagtattaaaatactaccagtaccaaatgtgcacatggaagactaatgaagagcaaaacccaaatctgcctattaagcataaatgggaacttaagggaaaatctgaacaaagtctaatgaacaaataaaatataaatagacaatgaaaaaaatattgaaactagtccccaggacacttccaccattcgacagattcaaatcagcaaacatttattaagcaattcactgctctcaagaatgttcaattctcgtgcaggagccaagacaaaccaataagtaactgtgataaaagacaggatgagatgagtgctggaaaaattccataggtgcccgaaagggaggtagtacacttcctgcagggacaagggaaaacaataaagctacagtgggaatggttttcaggtatgagtacaaacaagatggccacaaattaagattgattcacctagcaagtctgaagtaatgagaatatgttttaataaactgcatgcacacattttatactgtctattgagagtctgttttataagaaatataatgttacgtgctataagggaacacaataacatttctgacatctcctaagctttacaatccagctggggagcaaattatgcatattgtattgtgaattccccaagggcaactgatgtgtcttttttatctttctattcccatcctcttgcacaatccctgcaacatcactggcactaaatgtctggcaaatgaataaataaataagtgactataatacaaagcagaatattatacgtgtcactgataatccgtattagagaagtttaagagagggacagaaagtaagcaaggaagctgcactatttctgtcatctagcactcactcctcatattcctctgaaaatcatcccttcctcattatctgtctctgtgattccttggaacagactcccagggaggacatgcgagctaaggcaagcacatagaaataccgcgtttccctggttatagcaattgcttcaagagtgcatacctgccccaagccccaccagtgaaatacaatcaccactaatcttggggattatgcttaagcaacaaaataataagttacttttcctgttgaatttggagctgagaggatgaaaacctagaacttttggccactgtcttgccaccctaagaagaaaggctatcagagaatcgaagcaactcacagaaggaaagcctagcaatggggggagaccagaccctaataatgttgtttgagcccctggccttagcaatgctaaaaggaagcatttttcagtcatagccaacaaattccttttgtgcttcattcaatgtgggctggatttttctgtcatgtgaaactgttttcatgaaaagactgaattagatttcatcactgaaaactgcagtgggtttttaaatacagaaggaattcaggtgaaaaaaactgtataaacaataagtgaagtaagaaaacagaagactacttctgttacaatgatttatatatatatatttcaagtttaagttcagatgaagactgaatagaatgggttagggttagctaagtaggctgagtatagcaaattggacagttcatgcttcacgaaggggtggctgctacccagctcaagaaaattactgcgatgtggaaactgacccaatatggccacaactcccaattttccaacaaaaagctcaatctagactttacaagaactggcaggagttaatagcaaaagaatgagtttatagcaacatacagaaccaataagcaagtctatgaggcaggatccagcagttagctttgtgactcagaggttacttaaatggccaagaaagtaaaatcaaatccatacaaaaggtatgtggacccaagtaaaggtttcctaaacaccacaaatatgtgggtcttctacggaacactatatgacaagagaaagaagagagaattgcggatatacagaaaaagcaatggaatgaatagctacagcactgagctcctaacacaacaatagctgaagagcagacagagtctatgctctcaagtcaggctgcctgagttcctacccaggctctcctactttgttgttctgtgactcctttgaccaagtgtcctcaagtataaaattctgctaataatagtgcctgcttcacagagttgctgtgaggagtgcatgagttgatacttattgtggttggcagaattttaaggtggccccaagattcctgcacccctggagtacacactctgtataataaatgagtgctgttttaagccactaagatcatacattcctccctcagtattgactctagcacccctgtggataccaaaatccacaggtgctcaagtcccttagattacatggcatactatgtgcatatagcctgtacctatcctcctgtatactttaaatctatacacttataatacctaatataatgtaaacactatataaattagttgttatactcttttttaaattttatattatttttattgtactgttatttttcatttcaaacatattttatttgtggtgattgaatctatgaagaacccaaagatacagatggctgactgtagtaatttattatgcagcaatagaaaaatgtgtacagcgataaagtacttagaacacagcttgacacataggaagccctcaataaatatcagctattattattggattctatttaagtgtacattctggtacatttaaaatagcattctaattacaaaaattcagtttgtccatatcatgtttgctagcacagaagatgcacaggcagacagatgcatcccagtgatacaaagaactagggcaggcaattgactaaaaaatactttctacaacacgtgtattgagagtgattttaaagtgattttgtagaaggaaactaattattgtgttcatctactttagactggaatccagttggaaataagttcaggatattcaatgatagtctactaacctaaaaacaaaatataacatcacaaagttatttgtaatacatattgggtcaacaaatacttagcagagaacaaagcataataattttactggtaaatgaaattatagttttatgtatgtgatagtattaaataaagatactatatttcagatgctcgtaactaagaaaacaagccataatacaaaatacatttgcatgaactcctatatagcacacgtacaaaacaaatagtataaatctgtataaagcaggcagcaaaatataatgaacttgaagtcattcccatggacatagccataatacatatagaaatttatttcagtttaaaaaactagttcaaagcacattgtaaaaataataaacatgaaagactttcaatgtaatgtgtacatatgccataaaagtacatatttctctgaacattagtaaatgaccagcaactgaaaatatgataaaaatagacttcaatgaatacataagcaggaaaaaaaatagagaggaaaaaggtatcataaagattttgatgtttagcctcaaagccaagtaaagcaagcccaaagcatgaaaatccacttactagcactgctagagtttggagttttctctttatcccaagcatttatcccattagccacacagtcaccattatctttaaaatacaccccctgcagcctaatcgctgtacaactcttgacattaagtttgaacttaatgttctgtcaatgcctctgctgctttctgagccataggctacaaattaataacttcatatgtaaagaggaaaagccccatgataaacctctgtgggctgcggcttgtttgtttttaaaaactaccaatgagacatgaaactttcatctttgttgagattttttatgttcctgcactccatcattaagagcagccttgcttgctacagcccaccaggaacaactaacatatacctgcttggtcttacaccctgcaacaggcacagaagatagaagctaaattctcatacgattacttggaataaggagcatgtgttactttacaatctattgcctaacataagtcccttttcctgaggttgccataagcttacatgagaaggtgtcctaaatctctcacagtaatgctgaatccgaaagggttcggagcactcattttgaggagcacagacctcattcagtgaaacaatgattaaagattctgtttcatattttattctaaaatcttacaagaagatacagaatcgcttccagaaaaatgttgaactccaacaacaatttaatagaattatagaaaatctcatttcaacacaagcctcagcagaagagcttccttgttatcttcaatgtaacacaaatcatctttttaacataaaatattaggaatcatgctaatttcacagctttgttacattagaaaaaaaagttaatggtcaattcaggctgcatccattttataatgtacagataaggggtattttctcataaatctgcttaaaaatgaatattaaagagggataacgtgacaccatgtcaaataaacaaataaggatgataaaggaaatatagctatttgaagaagattatttgaaataacacatgggcttccatagtcatatttagagaaacattctaactaaagtcagactttgtattaattaccacagaattcttaattacaaaatctaacatgaaggaataaaaaaacattttaaggttcctttcttcaaaaagtacacaaagttagcttgtcctacaattttcagtcattatcttatcttaataaatgagtatgatatttaacagcccaactctcctctttaatttgctcttgatgtctaatggcagcgttcaaccatgacaaagcaaaattactaaagttctcaccttcaagtttagaaagagctattgttgataggtgagccatgtactcacacaacttacagtggatttgctgaactctcttggtggcaccacaaaatatatttctgctcctgtcttcattacaaatcaaaattgaaggcttatacaaatttaagctgcattaaaaatattcaacaggatcccagcacattgggaggcggatcacttgaggtcaggagtttgagaccagccaggacaacatgacgaaatcctatctctactgaaaatacaaaaattagcagggcgtggtggcgcctgcctgtagtcccatagtcccagctacttgggaggctgaggcaggagaatcactcgagcccaggaggcagaggttgcaatgggcaaagattgtgccactgcactccagcatgggtgacagagcaagactccgtctcaaaaaaaaattcagcggggtgtatcttcaaactttgtgccattttttcccttgaaataaaaaaaaaattagaaactgggacagatatatttttcctatttgaatgctcatgaataaaactatattttatactctaaaattataataccttaacagcatggtggaaccactaacagatatggcttttcaatggatagtcactttagtactttagtataatacttaagagatcacacaatacataaaaataaacctctatctccaatttattatggtataagtattaccaaaattaaatttgtacaccacttttaaggtgtaatattgtaaaactctgcactacaaagaattaattgaagcaaactcgctcagataagatcattttgacctctgttcttcacgctagacattttcattacagaacaaaacagtcacaagtttactaatcctaaatgacttggcaaagccaatcctaatgacaaggattttgccgagtcatgtaggatttaagtgactctgtggttcctggtgagatacagtacttcaaaacacactggctgatcctcagaccaatgacctgacatcaagtcagatggaagtaactttgagtttcaaacataggggaggatgggtttttcttaagaatgaaaaaaaaaacaactcagcttttcattcagagcaatatattctgagaaacaacttatcattttggtaaaaacaggagaagcctaatcactcagcttctactctggagtataaaatagttttcacacttttagtccacatgaaaaatagctccgctgaatttctaattgctgtatttagtgctgaatttgtccttttatatattggccacctcctttttgaaactctcttcttttatagatctcaaaccacctgagatcccaaatcctgagtcaccttaagtggctctttctcttcatgtctttctaaaaatccttctcagtttattctgaaaagcagaaaacaaaaagcaaaataaacaaacaaaggcctacagccacgtttcccatttgaagaaccctgctctcataaattaggggattcttttttttttttttttttttttttgagacggagtctcgctctgtcgcccaggctggagtgcagtggcgtgatctcggctcactgcaagctccgcctcccgggttcacgccattctcctgcctcagcctcccgagtagctgggactacaggcgcccgccaccacgcccggctaattttttgtatttttagtagagacggggtttcaccgttttagccgggatggtctcgatctcctgacctcatgatccgcccgcctcggcctcccaaagtgctgggactacaggcgtgagccaccgcgcccggccaaattaggggattcttatcaggaagagaaagcagcacgaggagggctcacaaagggaagtgaggctcactagaacagccccaggcataaattgcaggggaaacctgaaatcaactgctcctaacccaaaacaggcacgtccgtcaagcatgaaccagcagcaagaagctccttggcatccagtcacaaggatctaatctcaactccaggtacctcggtagcctatttgcaatggtgactgttaaattctaggaagtcagcactgactcttccacctacagtatcttccattaaaggccaaatcaaatgatctccccactccaaatctccatcttaggtctccgcatcaccattatcgcagtctgctggagaatactgtgagcacctccatgtactgaacgtggaaagcaagatttacaaaaagaaggcagcacagttttgctttcaacgaatcttcaatataactatatttatttatatatttctttcatttatcctaccagacagggcggaaatgaagtcttaattatccttatttctccacatggtgctgtgaatagagtcagtacaaatttgttgaactgaaatttattaaactggttctttctgacctaaaagagccaagtaagaatcccactgctttgttttggccctatttgtccactttttcaatatgccatagaaataaaaggatgacaagtcaaaccaattttcccccacttctttactgcaaacaaataatactaaatattataataatataatactaaatatcacagtgatatagagaatgagggagagagtttcgtcccagaagaaggccctcctagccgactacaacagcaatctctagaaaaaccccctaccaaactgacaaattcaaaacagcaataccatatgatacttaagaggaagaatggttcacatttacaatttatgatagcacaaaggcactccagaattttatgttcagtgtactgaatagaaagcagctgttaggcaaagcatgattaaatgacttcaatatgggagaattaatcacattttcttatactcgggattctgctgtcactcaaaaataaagatggaaaggactgtaaggtcagtatttttaaaaacaacatcaaaatgggcacctaaactagtatccatctaaaaaatgtaaaatgactcacaggcctaagatagtaagattttattatccatctaaaaaatgtaaaattacttatgtgcctaagatagtaagattttattatccatctaaaaaatgaaaattacttatgtgcctaagatactaagattttaaaagcttatttgcactaaaagtttttaagaagcatccgttctgtattaatataattagtagaacatcaaaggtgcctccaaaaccaatatgtattttttaattgtgaaaaaaagtttaatactagcaatactaaaaaaaagttaaaaaaagcttaattgttaaaaaaaagtttaattctcatttaattttcatttcacagactaggctacaattctagcaaaacaatgcatttatcaaaatacatgatcacattatgccatggatgggaaaacagaaatataaaatacatgcagacaagaaaataaaagcaggcacttggattatcatactcctccagccagacgaaggtatagtgaactagagagttcaccacaaacaggaatagaataaccaaaaactccaatacatcaaacatgtcagaactgaatggctgcctgaaaatgaatgcccctgaaaacactatccttacttcctctgtttaccaggtagaaagtttgaggattctattttgtttctcatactctgtgtctactgtggtcaatcaaaaaaatctactgaagttaccgggctttgaaattacattcagaaaaaagcaagctggactgtgggataggtatttatcaatgaaatgctcccaaggacactaatgaggttttagaaaagaggaagccacttgctgagacattgccttcacggccaagagtctttactagccaattccatagcactcttcctatgaattataatttagaaaggcagatcccacccaattctagaaatataagttcaaataggccctaagaatctggtgaactccatttaaaaaatgatttgtctctgcaaaagaaaaaagaaaaagatttaactgactgcaaatgagctttactttatggaataccagacactacatgaggaaatctaggtttttaagacagagcaatgagcttgccaaaataaatcttcttccacaaaaaggttcataatagaaccctgttaaactctaaattttcctagttaatataacctggtatattatttataaacattataagcaatgttttcaggaaaaaaatttgctgtacaatacagcactgaattctatgtttatcattttgctataaagataattagaagtaattagtaacttggcagctccaatgaacaagacctgcttttttcagaaaccattaatcctttgattcttcatagaggacaagagaaatcggaggcaagtctacctgaaaagagagaatgacacgaatagactggaagaaaagagctccaaaatgtctggaggtgagacactgacattcattttcagcagccattcaatcctgatggactggagcttttagctcttcccattagtgatgaaatggccagcttaagatactagcacctaactggaggagcaaaataatggaagttgctgccctttctcttacccacttatattttacacttctgctttcccattcctgtcctaatggacatgtctaagagagttgtgaaaggtttcctagaaaaggcaccatgtttaaacgaaatttgccaggcagagctgaagaaactgtacgagcaaagcttggaagaagaaaaggaatcctgagttttaggggaaaggacaaagagtaaggcttttttttttttttttttttttttctgagagggagtctacctctgtcacccaggctggagtgcagtggcgcgatcttggctcactgcaacctctgcctcccaagttcaagcaattctcctgtctcagtctcccgagtagctgggtctacaggcatgtgccaccacgcctggctgacttttgtatttttagtagagacggggtttcaccatgttggccaggctggtctcgaactcctgacctcgtgatccacccacctcggcctcccaaagtgctgggattacaggcgtgacccaccacacctggcctaacagtaaggctttaaagagcctactcaactaatactgaagactgttagtaaatatgtgacctatggaatgatcacactctatagaatgatcacactgactgagagctctatattattttgtaattgaaaacatgagttgttttcaaaagaacttttaaataccaagatgatgcaagtttaaaccttccttgtcatggagaaaatgcccttccactccaataaactaaaagataatttttaactatacagaacataatgtcttgtttccacaaaatgctaaatactttgcaagattctccttgctgactctgaggtggcagaaagtgacaaatatcatccaaatcttactgatacaaggaaaatattttcagcacaaaaaaaatctttgtagcatcatcattgctctaaagaaaagctagaagcctgccataatgattagcaaactcatatagatatctccaggaaaggatttacaaaatgtcatcacatccttgtaatcatctaattatcaaactcagcagtgttgacaaagcacaagcccactcagctactgctaatgattattattcaaagctacatttctaccaaatcagaataacttacaggtagaagctcattagccttaggaaccaccctccttgaacactcacacgcacacgcacacgcgtgacacgcatacacacacgcgcacgcgcgcacacacacgcacacacaccccagccataactaggccttgctgaattgtcatttgctttcatgaccctccttcgtgtatatgagcagctttacgaattggttcaaaaatacccagcctttcaaaaataattccctatctagaaaaataccctacagacatctatatctagagaaataccctatggacattagtttgctaatgtcatagcaacagtgcggcaggcatcgtcaagctttggtggcttgaagaaacacactggcaatgcaacaatgggaaggagctaaaacgtaatgtaagtgacaatgcaacgtgaaggaatggaggcataaaggcaatgcaacaatgggaaggactgaaagcataatgcaagccatggaggaaaagcatacactcactgaatctccgcaatctacttgtcactacaccaggtgctaggaaaatggttacgaccctcaagctgcttgcagtctatgcaagcagtcagccagctccaggaacgtggcatgagatgaagcttgcagggtcctcaaatgccatacttaaaagccttgatttcatacaaaggcagtagggaatcaacagacatctttttgcaagagattaaatgatcaaatctgggttttttttcaattatctctaatggcaaaatataaaaatgaattgagactcagggaaacagtgagaggcaaggatatgagttagaggccatttaggtgagatcggaaggattttaataataactgggacagtgacaaaacaatataaaaataaaacaatagagtcaagagatctttaaaagcagcataagcagggcatacagaagtttgggggaagaatcagaggtattcctgatattcctggcacggctggctcaggagattgcaacgtcaagagagaagacagcaaaggtggagaagcagtatgctgtgcggaagaaaaggcagagtttaggcactgcacacgacgaatctgaagtaaaaccaggtcacatagatgaagatttttgttggtatatagaaaatatgggatgagctcagaaacacaggcaggcaagtaaagccatggcagcaccatattgtcattcaacaggtaaccagagacaaatcagcaaataacttttaaaacaaactggtgagacaggcagaaggacaatgatgagcaggttaaaagacttccgaaggttaaacactatcacacctcaaatctgcataccttgagatttaagtgggtattgttggttttggtttgtttgtttttcgtttttttgagaccgagtctcgctctattacccaggctgcaatgcagtggcacgttctcggctcactgcaacctctacctcccaggctcgagcgatcctcccacctcagcctcccaagtagctgggaccacaggcatgagccaccacaatttttgtattttttgtagagatgggttttgtcatgttgcccaggctggtctccaactcctgagctcaagcgatctgcccacctcggcctcccaaaggactgggattacatgtgtgagccactgcacctgggcaaagtgggtattgttccataaaatcttggccaaatgggaaacaagaaaacccacagtatagtcacttcttattacagaagacttttgaggcccccaaacaatataccttaccaacttctgctctaacctgaaagacccacagccactgaatgattgtgaaggaggaaaaacagaccctaggacaccaaccagcaagtcacacacgcctctgcagatgctgtattggctgaagaaaatgctgccacccatcggggaaggaaaggaaattctattaaggatatttttaattctgatcctaattcaggtgatcctaattaaacagctctgcataaacagtgtcttgataaatttttcctataagcatcaaaacgaaaaccaaatgtcaatcaaaacttgaaatagcgcccatgactgccaagtctggtcacatgtagctctaatgcttttcttttacttgacaagtatttattcaaaaacaacattttaaaattatttgcctatgtcattaatatcaagtataaatgttaaggtcaaataaatatcactaaaagaaaaagaggtgttaataaggccaaagagtattttcttatacactgcatatatagtttatagcatagaaaatgtttaaatctataaatgcatgtatctatagaatcatagggaaaagcacacccaataatggcttgaaaatgataaagactcaatctggagggctcctgaataattaatgttttaatatgcagtactaaaagattgtagaatgcagatttcaaaaggtaccttaactccatgcaaattccatgtcaattatctttattttcacatacagttgtggcaacatcagcacagaatcatttgacatgaataatccaccctcctcccactcaaactaccagcatttatttagatttgaatatatgaaggacagaggtatgtaaggcatgatgtaccacctggataaaaatagcagaaatcctgattaaataatttacagttttgcctagagcaatactttagtattagagaatattatcaaatattcttatttccatcattctggattttgctaaggcttataatggtccataattagggctctaacagagaactaatataacacagaatgcagtatggtggaatgcagaaaataagaactctggaatgaagaaagccatgttaaagctctgtctcttttacttaaatatagtgtgaccttacgcactttctcatctacaaaggcacgatacccataactcagagggctactatagaagataatgtgaaagtacacattaaagtacttggtagaataaaaaattaaaacaaaggagtgcggcactaggaaacttgtgatcaatccgccaattgtcccttgatctgttgatgtaagacaggtaccagtgtctaatactcatttgcttcctggaaagtatgggccaaaaaatgggaaatacaagacaaatccacatactcaaatatgtaatacagcagttctgtttataactgagttatctgaagggaaggcagacagctggtttgggaagccaaaatcatttaaacacggacatacagaatctctgaattgaaactcatcattagacaagctaatctagtttcaaatgtcgaacgatactattctgtaacttatttttaattttctgcctttacacagataggcttcaatataagaaacagatattgctgaaaggttgtctgtaatttaacttctgtttgctgtatcacattttcacttcaacttagcagctaagttcttgagcacttgggcatcaactaacagaaagggcattagacagaactcagaagacttcagttctagctttcttcctgtcactgggtgactacttccccctctctaagccacaactgatgtattctggagaaagggagaggagaaaaaatgggaaggctatggtatcagagagtttctgtgatctcttcagccctaaagttgtataattttattttgcttaaggaagaaaatggggacacatgacctattttcatgaaatttatagtctaagtgggaacctaagaaaaaaggacagacaacttagaaagtaggggatagtcacagttgtcaaatgcttggcatagaaaataacagtgactactgattttacaaaagggaaagctcaatcctaaccaagtagatttcaccaaagatctgagtagaaaccttaagaataagcaggacctcaatagagagggcgagggaagataaactacacccttccatgatgcaccagaaatatcacaaactcacaaattcaaagagcagtttacatatcatctaggcctaccttatagagacaacccatcctgacacgtaattctaatcctcagtgaaactcttccaggaagaagtagcttccagctgtaccaggacacgctgatacgttgttggaacgctctggttataaagctcttctagataataaaacagtatttttgtcctttcttcatcatgctttgtaaatagacatttatttgaatatgtctctttaaacatgtaacattaggtactaaacacagaaactgtaatgaaaatcaacttttgaagatagaaggaagactcttcctctttgattaagatgctttaaaagaatctggtttggcgaagccatccccaaactcgcctgcttacctttatgatataccaagtcatcttattttccacatcaaatggcaatgtctgatttttgcccctaaaaaaaacactctgtttctgcctattacaaaatttaatagagcagtttatcacagtttttcatcactcttaatattatatctctaaaacatatttgttttttcctcccatgaaaggtccttcttatttgcaatagaaacagccaaatcataatttaaagtttgagggcaataatccacaatctaagaaaaatcaaacaaaaactttgaacctgagttacataaccacaatatttctaatagaaaattttatctttatgtttcatttcaaaacaaaataacaaaatataacacctttaattaagaaccaaaagcatgatagcacatgtctgtagtctcagctactcaggagactgaggcaggaagattgcttgagcccaggagtttgaggtcagcctgggcaacatactaagaccctgtcttcatgggtttttttttttttttttgagagagtttcactcttgtcgcccaggctggagtgcaatggcacaatctcagctcgctgcaacctccccctcccaggttcaagggagtctcatgcctcagcattctgagtagctgggattacaggcatgagccaccacgcccagctaatttttgttgttttggttttttttttttttttttttgtagagacggagtttcaccatgttgcccaggatggtcttgaactcctgacctcaggtgatccacccaccttggcctcccaaagtgctgggattacaggcgtgagccaccgtggctggccaagaccctgtcttttaaaaaattaaaaattaaaggccaggcacggtggctcatgcctgtaatcccagcactttgggaggccgaggcgagcggatcacaaggtcaagagatcaagaccatcctggccaacatggtgaaaccccatctcaactaaaaatataaaaattagctgggcgtggtggtgtgcggcctgtagtcccagatactcgggaggctgaggcaggagaatcgcttgaacctgggaggtggaggttgcagtgagctgtgatcacgccactacactccagcctggtgacaaagtgagactcctactcaaaaaataaataaataaataaaataaaaatttaaaaaaaaaggaaacagctaagaatgacagtttaaaatattaagacaataaagtccctgctttttctattttataatttctttctctctttagtaaaataattgcagttttcttactataccattgagataaaacatttttaaattattgaattaaattggctttagagtaaaacaaaaattgactcaaaaaacaattactgtgtgtgtactgtgctcagaaatgtgaccagcaatgtaaaccgacagaaccaatggctttttagaaaataacaaagtatttccgatccttttttaagtagagaattttctcccagcacatcctatttccaattgtgtgcaaaaaaccttccagcttacaaatgttaattcaggggttggcaaataaaggcccagaggccaaatctggcccaccacctgctcagtctgcaagctaaggatgttttcttacatttttaaatggttggggagaaatagaaagagtatttttgaatatgtgaaaattacatgaaaaatcagtgttcagtgtcaatgtttctttggtatacagccacacccattcattcacgtattgtacacggggcctttcaggctacaatggcagagttgagttgccacgataagcatgtgaggtaatgcatatgttaatttgctccatttagccactccacaatatatacgtatttcaaaaaatcatgttgtacatgatatatataatttttatttgccaatttaaaataatttttttaaagaagcagctaccacagagaccataagtagcactctctttacacactacaaattgtcatgaggcagttgtgactcacttttgtctcctgcctggaaagcctaaatatttacaatgtgagcttttagagaaaaatgttcttcaaacctggaataattaatatagttattcatcattccttgaagaacttagtataatggcagtctctatgagtcagagctatcaagtaattactagatttcttgaatcttatcatgatattagtgtttctttttgtcaagtctcatatatttatattatgtattaatttttaaaaatacattatctgggccagctgtagtggctcatgtctgtcatcctagccctctgggaggccaaggtaggagaatcacttgagcccaggacttcaagaccagcctgggcaacatagcaagaccttgtctctacaaaagtaaagcaaaatattagcaaggcatggtggcacacacttgtagtcccagctgggcaggggaatcacttaagcctaggagttcaaggctgcagtgagctatgatcacatgactgcactctagcctgggtgacagagcaagatcctgtctttaaaaataattttttaatgaaatgaaataaaatataaaaacatttatcaaagtgtgctccacaaaacggaaaagggatactgttttctcacattccttcaatccgtcaaaaattaaagacctcctgcatacaatgaaggttgctaggaattcaaaataaataagatgtaattcctggctccacgtaattgcattctagtagagagacacagtattccagtagattgttgtcactaaaggaaaagccaaagcaatgacagtaacctttgccatttcataatgtcatacagacatttaaaaaatatcacctctgtctgcattaatggcaagttatacacttaaatagataaagcaacaaggcttgacaaacacatttatccatcaatactttcaagcaaagcattagccttacataagcaattaaccttgaccaacacgggtataaacaaaaatgctgattaagaacttactaattatccttcccaacttcagaagtttagctggcatctggtttttaactatgataaatatacaccaactcatcataggttattaacacataagtgaaaagaaatatttaaccaaatggctacgaatgaagaacacgataaacaaatatcatcattaaaaatccaaacaatgagttgttttctttgaaagcccaagtgtcctacaaacatcactttatttgaaggtagagaaatatttctgagaataattgtctcctgaatcaacttcgagattcaatctgttgtaataaagacaacatatataaatcatagatgcatgacaccgtttcataattagaatgccaggatctgcatgcagttaagcatcctagctgtttgcctgctttacttaacaccagaagagaagtataatcccaacagctaagtattctagcagctgttgtgagcagagtagagagatgtggcatgtagcagtcaccaccacacgtaaacacacaagcaccccggtgactggaggttagcaatcctggtgtgcctgctcgcttttagtgttaaatatttaatggcatatttttccttaatggaacccaggcacatctgatcagtcactgggatcatttagtaatgcagtcaaagttatcatactgccatttcacatcaactttgtaattagataatccatcactttattaattcaaaagattgctttctttactaccttatagcaggctacagcagtgaaacccaacagagctcatcaacaaaaaaggctctaaaatctggtcctacatgaacttgaaaccctcaagtgacaaacatatacacactcctgacctttcaaaacaacagaggtaatactcttcccacaaattagcccaccaacaacaatgaagtaacagagcaccagtgtatccagaatgagatggttaacagaactgaaaatttaagcttaaaagctgaatataacatgatcaactttgttctcgctttttattgaggtacactgttcaccagaggatgaaaaggatacacaaaaaagtcatttagtaattttccctccatgctgatttatatacttcactaaaattatgagggaggttatagcagaatatcacatccattatttatgatcactctaaatgtaaaggcacataccggccaaacacaagcatgtaatcttgaatatagtatcacgattttctcttgctttatttctaacataccacaaaatattaaatcgcgatttcttatcgtattgtgaattggtaagattctcgttttaacaccttcacagcttctccaatttaaaaaaaaaagaatcctccaataaaaaataatttactcagaatgaaactgtaaaatttaaatatcatagtaccaaaaacaccctctaaaatactcactttccaatctatgcaaccagtacatattgcaaaaccagctacagctaatataattaaaaattagattttggaaaagcaagctccggaggtcacatacgtgccctaaagaacaaaaataacatgctaccaggagaattattaatttgaaagaaagaaggagagaacatcttctcaaacagatgtggaatttctaatcaaaaaaattctgtggcagttgcacaacattataaagttcagcagtactttgcagagctccggaaacactaacaatggcatatgttctgtggtcaggaaggtcacttttattcttgttgccgccaatctaatgcctgtttttgaaacattctatgcaactagtctattttctattttattgttcagattttaccacatttctaatcaggctgccaaataaatttttagaaaagaaagttataagcccagaaaaaaaaattatatatttttctagaactctgtacaataatccctaaagaaatcttttatgtgcataaaaaaaatctcaaaacaaattctactgaaattacgttgagactatcaataaccattgccaataattatcaatggacattttaagggatagaatagagaaatacaatacattccatggcgtttcaattaattagaacatgacaactgaagcacgcttaattccatccttttaagatgcatgtgtgagaaagatttccatcatcaagggaagcctacttttacatttcccacgtgaaattccaagaaactactttgataccatggagtttctaagaatgttggcaacagtacatgatttctgtccacaatggctatgactgaaactaagcctcaagaaaagacaccattgcctgtttgcaaaatttcttctcaacaaaacaggtaattctcaggatctcaagagacaccagcactgggcacaactgtgagcaaccatctgagactctagtttacaaacagtggcagactgcgctcttggctagatgacagcacagggagatttaaaacaccaaagttctataatccaataaaaataaagctgagaggtgggagcaacagtagtagaaattaataatatgtgtcagacactactaagtacgttatagttgatcctccttgaaatctatgaagtagatattagtatttccatttacagataagaaaattgagatggagagaattttatttacttgactgaggaaaatgacctaaccatcatattattcagcctcccatttaaatttggcctctctctaactgtaatttttgtttgttttgagttggggtctcactccgtcccccaagcagcactcatggttctctgcagtctcaaactccggggctcaagcaatcctcccatctcagcacaccgagtagctaattgtaattttctgagtttcgaaggatatatttatgcttaggagtatatacattttctatatttgtagcaaatgtttcggacccaatcagtacaccgaatcacagcatttgtcatgccatgataaatttttttgagacagggtctcactttgtagtccaggctggagtgcagtggtgagatcacagctcactgcagcctcgacttcctaggctcaagcaatcctcccacctcagcctcccaagtagctggaactacaggtgtgtaccaccctgctctcagctaattttttttttaagtttttttgtaaagatggcatctcgctatgttgcccaggctgatctcaaactcctgggctcaagtgatcctcctgcctcggcataccaaagtgctaggactataggagtgagccattgtgcctgaccaataaatccatttcaaaatctaacaggtgctgggtggggtggctcacaccagtaatcccagcactttgagaggccaaggtgggtggatcacttgaggtcaagagtttgagaccagcctggccaacatgacaaaagcccatctctactaaaaatacaaaaattagcccggtgtggtggcgcatgcctgtaatcccagctactcaggaggctgaggcacaagactcaacttgaaagccaggaggcagaggtgcagtgagccgagatcacgctactgcactccagcctgggcaacagggtgagaccctattcccaaagagggggaaaaaaatctcaaaggaaattttgtttgaaaatggaagtggagatttaaaaaaaaaaaaaagtgtgtggtagagaggagaaacagcttgtagagatggagacatacatcttctcttctctaaacaatgtgaaaaagagccagcagagatgaaattggcctttattttttatatgcatataaataatcacatctcctgtgttcatctgtatatccccggtgcacttcctatcctttcaacaccttcattgctgtctgtggaaattaacacctttcattgctcacactttacacttttatctccgttcagccacacactccccagggaacatacaatctaagttttttaaaaaaaacaaaactatccaaataaagctgcaagtaatttgctctagcctctccatccaacagattatcactcagcatcccctcctctagagaaattctgggagtatccctaccctcactttctattacatttagtgcaaaacaaacattttaaacatcaagctcttattctaactctactgtaattactaaatataactgaaatctgtattccacaggtaacaacttcctttgaaaaccttctccggaggaggttgatatatttccctcaggaggttggaggaatcaacaccctcactccccaacagcatttctagaccactgtatatcactgtttcccaacaccagcctcgcttttgaaatttacgtcagtttccacttctgatatgaggtcctccttgacacccacccctagaaaaattcctccttcctatggctcatgttactcagtttttacagccaggcaacaaattcataagtggacaggatatatctatatagaaaactccacaatcaaactccaattgctattagggtgtgtgtgtattaacactggtgctaagagtcagagtcagactaacactggtgctaagaagtggggtgaaaaggaggaatatctgggaatatgaccgggaaaattacaagtaacagaagaaattttccaggtaaaattaaggcttacgcagcagatgcacgttcagcattgagaacccggtccgacaggaaagacacaccatttttccgccagaaactccagtgttcaaaatacaaactgccaacttttcaggcaataatcatgagcttccattagaaaaagccatcagctcaccagacgacgaaatatgctctcgggattaagaactttctcatcctccctgagccctttcctttcaggggaagtgcaagtttgataaagatatgcatattcttcaagtaagacttttgacctgctgaagttttctgccttgatagataattttgagatttagaattagccacatacttctacaaccctgtgtcaagagtattttgtacacactagacctgcaaataaataaataaaagtctgctgtacttgctaagcaaattcagattcaactaacaaacacctctcagcagggcaagagacttggtaagaaaagactaattctaatgaaggtttaaaactccgaagagaaagaacatctgtgtgaactgtaagtattaaaaatgacagatataaaatgagtctgaaaattagggaaaccagctgatagaaacatgaagattcattctactagtccctctatttttgtgtgtgtttgaaaatgtccataatttaaaagtcaaaaaaattaagacataagcaattttagaaaagctctcagaattccatatgcctttcaatgaaaattagatggtctaaaactggccgggtgcggtagctcacgtctgtaatcccagcacgttgggaggccaaggcgggcggatcatccgaggtcaggagattgagaccagcctggccaacgtggtgcaacgttgtctctactaaaaatacaaaaattggccaggtgtggtggcaggcgcctgtaatcccagctccttgggaggctgaggcagcagaatcgcttgaacccgggaggcggaggttgcagtgagccgatgttgcgccactgcaccctagcctgggcgacaagagcgaaaactccatctcaaaaaaaaaaaaaaaaaaaaaagatgggctaaaacataagcttagtatgtctattatctgcacagaacctgaatgaatgtaaatgagaggaaccaaaagaaaaacaaaaaacaagatcttgtttattgaggccaggtatagccagccttgttgacagcgtaaattcagaagtcagcagcttcctctgtatgtacaaactgtcagtcagggatagttgcatgttgacccgctttccacagcctaatgaactgacttttgaattttcgctgtgaagaaggctggctttacctggcctcaataaacaaaatcctgttttatgttatttttttatggtgcccgtttcttctctttgattaattaattttataccagagtaaaatgaggagaggagcagtagactgggataaaaatctctgcccagggatcttcacccagttcccgtgtgcttgatgtgacttgcaccatcacacaccgtcaacattctgggctcagtgactcatccctgaaagctgcaggatctatttaggttaatttaggatctttcatgaacaaggaaggagaaggagtcagggggcgggaaggagggagaaggagtcgggggagcgggaaggagggagaaggagtcggggggcaggaaggagggagaaggagtcgcgggggcgggaaggagggagaaggagtcggggggcgggaaggagggagaaggagtcgcgggggcgggaaggagggagaaggagtcgggggggcgggaaggagggaaaaggagtcgggggggcgggaaggagggaaaaggagtcggggggcgggaaggagggagaaggagtcggggggcgggaaggagggagaaggagtcgggggggcgggaaggagggagaaggagttgggggggcgggaaggaggggagtgatttaaggacaaatttataagcagaaaaatacaaattaaaaacattaacaaaactttcaccagaaagtacagaagccataggttattggctgctttcatctgattattaacctatattttaatgcagaagtgacacactaaggccaattatgcccaaaaatctcaaaactgtgtattttctagcaataacaaatattatgtggggagaagggtaagcattatattaaaaattggtacacttaatcatagcaacagaattttccccctatacaacatggagataatttcattataaaatacatgagactaaaatcttcagaaagaaagaagaactaggatagtaattcacattttacatgtagcaacagaaagtattttaaaatatttttcatggatattaataacatcagtaattatcactggaacattttccaacaatagaaataattaccacagaatagccacaaacttaacactaggaatgaggtaataatcatcataaggtatatttttatctttcagtaggtgttcgtgtttatagtgttgaacatgaaaacagccttgggcacggcacacgatactactacaggttataattttcagaagcatatgaaatagatgagaaagttttcagatgcactgtaagaaatcagtaaattttgaaatcaattttaaattatagataaccagaatataatgctaagatgacattaatcagaaaatcataaaaatgtaccatacagaataaaaatacatttgagaaaaactggaataaatctccagcaatcaaaccaattacatttaatttttcagaaaacagtaaattttaaaacatgccttaaaatattaatggcataaatatatcttcaaacgtgtgcttacaaattacaaaataagtggcaaaattgtcaaaagtaaagttttacttgttattaaattgtgatcaacattaaaacaaatgcaaacacacaatgtgagaaagcgaggacagcagatccatagcagtgagggggtgtttctgtcatccctatcccagggtaaatatcaagaagcaatcatttcatgcctatgggctagtgaagaaaaaaaaaaatcaatcatcgcactcttcctccctaggccaagataaaccctcggaatcatttaaaaaaaaaaaaaatacttcaggaggccgggcgtggcagttcgcgcctgtaatcccagcactttgggaggccgaggcgggtggatcacctgaggtcaggagttcaagaccatccgtctctacaaaaacaaaaaaaaaaaaacaaaatttagctgggcgtggtggctcatgcctgtaatcccagctactcagaatgctgaggcatgagactcgcttgattctgggaggcggagattgcagtgagccgagatcgcaccactacactcaagcctgggtgacagaacgagactctgtctaaaaacaaaaaagaaaagaaaagaaatggatttcaataaatttttcatttcaaagacaggctctatgcttaaacaaccaccataaaactcaatgaatgcaatgcaacggcaaacaagtccattcacaaaaaataatgggatatgctattttcttctgagaaaagaaagcatactctttcttccaagggtacactttgagaattcacaatgaacatactcaggcaataacaagaatattaatcaaacagaaaaattcatacccttctcaatgcacacaatacattctctcatgctctactcactatgataaggaagtaatataaggcattaagggtcttgaatttcctgtcaagattctcgacatttttgtaactaacaacaaaataaggagcaaatggttgatgtatggaattagcaaagagcaaacttaacacttacttttgcaaaggcttcaaaaaggtcaaaggcaggtggcagctgagaggcatcctgtatttcttctctcatgaaatgttgaaatgtcattacgagttgcctgaggccctctttcttatcttcagtcagtttgttaatatcttttttaaagagaaaataaatagcacaatctcaaagtaaacttctgaaggataattttcaagtgttcaatgctggctgttaaaccagatatttcctaccttacattggattttgacaaagagcaaatacatattgttttatcttttgacaactaaatatgatgcatatgttatcaattaaattctgccaaattttgtctgcaatgtaagatcaaacacctatcaaaacataagtacgcacatatatgaaaaagcattaaaaccaaaatcactgagattgtgtgttaccagattttctacatcattctgtacacacatacaaacaattatcagttcttattaagtcagtaaacttaagcagacttttccatgaaataatttacaactaggtcatgactaaactaataaacagcatcacctctaaggcaaaaagacagaaaataagaactaaaaagttcagataaagttcaaataggttaaatttgtcatatggctagtacatcatgaatagaacagggatcaagcacagcaatttcaacttcaagttatctgagttgaataaacaagataaaggagcctggcgccgtgactcacgcctgtaaccccaacactttgggaggccaagacgggcagatcacttgaggtcagtagttcgagagcagcctggccaacatggtggaaccccatctctactaaaaatataaaaatcagcagggcgtggtggtgtgcgcctgtaatcccagctactcgggaggctgaggcaggagaatcacttgaacccaggaggtggcggttgcagtgagccaacatcgcgccactgcactccagcctggacaaaaagagagactccatctccaaaaaacaaagacaaaaaacaagatatgatgtggcatcaacccaaacagaaggagatggttctaaaacaaaagaagaagaaaagttctaacgccaatactacccccttaaatatcattttcaatcataccacaaatggggtgttaaggctgaaaggatacaacaggtcaattaataacatgtgagagcatttcacttaaggtcatgtgtatgacactagtactgagtagggctaatgtgaagagtaaaacccatggtaacagatgttatttacctagcagtaatataacaagaaaatttgaatactttgctgtcttttaaaacttgaaaagatacatcaagttgaactacagcataactctgttgcttatgtctatgcatatcctttagattacttattcaacagaataacccaatgatttctttttttttctattttatatgcttgttaatttttttttgatggtaaatatatgtttttttattttatttattttttcttttattattattatattttaagttttagggtacatgtgcacaatgtgcaggttagttacatatgtatacatgtgccatgctggtgtgctgcacccattaactcgtcacttagcattagatatatatactaatgctatccctccccactccccccaccccacaacagtccccagagtgtgctgttccccttcctgtgtccatgtgttctcattgttcaattcccacctacgagtgagaatatgcggtgtttggttttttgtccttgcaatagtttactgagaatgatgatttccaatttcatccatgtccctacaaaggacatgaactcatcattttttatggatgcatagtattccatggtgtatatgtgccatattttcttaatccagtctatcattgttggacatttggcttggttccaagtctttgctattgtgaatagtgccacaataaacatacgtgtgcatgtgtctctatagcagcatgatttatagtcctttgggtatatacccagtaatgggatggctgggtcaaatggtatttctagttctagatccctgaggaattgccacactgacttccacaatgggtgaactagtttacagtcccaccaacagtgtaaaagtgttcctatttctccacatcctctccagcacctgttgtttcctgactttttaatgattgccattctatctggtgtgagatggtatctcactgtggttttgatttgcatttctctgatggccagtgattgtgagcattttttcatgtgttttttggctgcataaatgtcttcttttgagaagtgtctgttcatgtccttcgcccactttttgatggggttgtttgtttttttcttgttaatttgtttgagttcattgtagattctggatattagccctttgtcagatgagtaggttgcaaaaattttctcccattttgtaggttgcctgttcactctgatggtagtttcttttgctgtgcagaagctctttagtttaatcagatcccatttgtcaatttttgcttttgttgccattgcttttcttaaataataatttattaccatgggaacttcagatcccacaaccttatataaatctgtactagatcatcttcttgtctccatccagaagtattaaactgtgcagcaaatttactgtatgtgccctggctagttttgagttgaaatcacttacaaccttaacgaaaaggatctgcgccaatacaaaatcaaaacgaaacctacctttgcttagcactcagatatgggaagctttttaagtcatcacaagaaggtggctacctacatggtagtttcagagaagaatgatgcttcacactgccacagagactgagtcatctgttccttctaccttccttaatgtctaaaagatcagtaaccctaaaagctctgtggaatccccctgttcactaatcactcttctctgacatcaaaaagaaaacagaacaggaaaccaagagacagaagaagggaaacagggaagaaaaaaagaagaaaaatgattttgtcaactggactaatggttacactaccccatgtaacctgaacatcttcatggcgctttactaacccttatcaggacgaagctaccctggaataagtgaaataaaccagtgtgacagttgtatataaaaataaattttgttaggtttgcatcacattataaagaaacagaaaaacatagttaaaaataaatccattcaccaactcagcaaacaaattatagaaacttttttaagatgctgatagacaatcacttacttgactccagatcataaaatgagtaaagcttctctgattctgaaggtgctccatccatctgtgaaggaaaaggggaaaacgccaataacaatttcaagtgttccaatatataaacaaataagtttgagtacctttgtatatttaaatgaaagtccatcaaaaagaacattttctatatattctttctattcatcactctcattagactgaattaatcaacaactttaaaataaaaatctaacttgtatcttcactcaacagtttaatctccaaatgcaaaactcttgtacaaaaagttcccatatttttatattcataaaaccctctataaaatcgtgtaccggccaaaagagtcagtaaacaataggaaaaggtggggcatggtagctcacacctataatccccgatactttgggaggccgaggcaggcagattgctttagcccaggagttcaaggccagcctgggcaacatggcgaaaccctatgcctaaaaaacatacaaaaattagccaggcatggtggcatgcacctgtagtcccagctactcagcaggccgaggagggagaatcacttgagcccagcagttcaagcttgcaatgagctatgattgtgctactatactccagcctgggtaacagagcaagtccctgtctcaaaaaagaaaaaaaggagaaggacaaatcgggagcctacaataatttgagaaagatattcacactaaagatgggtaaaaaaatctaaaaggcttcaccacagcaagatttcacagagtttactgttttgccacttatgaaaaagggccgaagaaatcacttcagtgaattttaggaaataagataagtactcttccagtcaatactaattatgtatgtgtatcttccttgaagaggaaagtagaaaatgacatgctcgccctgtgcattagtttacaatacccaagttataaaggcaatgtaacagagattactaccatctcatacctcagagatagaacctcctccatctttattcccacaagaagatagcagggccttcaaagagagactgtgtatttcttcactgctacagattccatgattaataggaaaagaacaaatttttttgtctaagacactccctggaataatctaccttctacattaacatggggttaatttcagccttaaataggaataacacaggcatacctcattttatcacacttcactttatagtgctttgcagacattgcactgaagatttacatcatcgaacaagtctgtccataccatttttctaacaacacgtgttcactttgtgtctatgtgtgacattttggaattctcacaatatttcaaacttttggttattattatatctgttactgtggcctgtgatcagagatctttaatgttactactgtaattgttttggggtaccacaaaccatccccatataagaccacaaacttaatcaataaatgttgtgcgtgttctcactgctccgccgaccggcttattcccactgcctggctattcccctatctcttccctctcctcaggcctctgtattctctgacacaacaatattgaaattaggccaattaataactttacaatgacctataagtgaaaggacgagtcacacatctctcattttaaatcaaaagctagaaaaatgagtaagcttagtgagaaagaaatattgaaagctgatatagaccataagtcaggcctcttgcaccaaacagccaagttgtcaacacaagggagagttctgaaagaaaatgaaaagagctactcccatgaacacatgagtgataagaaagcacaacagtcttattgctaatctagagaaagtctgagtggcctggatatagaagatcaaaacagccacaatattcccttgagccaaagcctaatccagaggaaagccctaacttgcttcaattctgtgaaggctgagagaggggagaaaattgcagaagagaagctggaagttaacagaggttggttcataaggtttaaggaaagaagccatctccataacataaaagcacgaggtggccaggtgcggtggcttacgcccacaatctcagcactttggaaggccaaggcgggcagatcacctgaggtcaggagctcgagaccagcctggccaacatggtgaaaccctgtctctactaaaagtacaaaaaatttagctggccatggtggtgggcgcctgtagtcccagctactgaggaggctgaggcaggacaatcgcttgagcctaagaggcggaggttgcagtgagccaagctcacgccactgcaccccagcctgggtgacaaagcaagactccatctcaaaacatacatacatacataaatctaaaaaagtgcaaggtgaagcagcaagtgctgatatagaagctacagcaaatgatccaggagacctaactaaaataattgaatttggctacactaaacaacagatttttaatgtagatgaaacagccttatattggaagaagatgtcacttaggactttcatagctagagagaattcaatgcctggcttcaaagaacaagtggacttttttttagggactaatgcagctggtgactttaggttgaagccagtgttcatttaccattcctaaaatgccagggcccttactatttgtggtaaatcgactttgcctatgctttaccagtgggaggtcaaaacagcaacatgaaccggagttcagaagattcagaagaacttggttccaaccttcatggataacactgaggggtcaagacttcagtagaggaagtaagtgtagatgtgatagcaagaacgaaggagctggaatcaagatgaaaacctaggaaatacccttctacacatcagtcttggcaaagaatttatgatgagtcctcaaaagcaactgcaacaaaaacaaaattgacaagtggacctaattaaaataaagagcatctgcacagcaaaagaaacctgcaatggagtaaatagacaacttacagaatcgaagaaaatattcgcaaactatgcagccaacaaaggtctaatatccagaatctataaggaacttaagcaattcacaagtaaaaaacaaacaacctcattaaaaactggacaaagggccaccacagtggctcgcacctatataatcccagcacttggggaggcctaggtgggagaatttcttgagcccaggagtttgagaccagactgggaaacatgatgaaacttcgtctttccaaaaaaaaaaggaaaaaacacaaaaactagcggggcgtggtggcatgcacctgtggtcccagctactcgggaagctgaggtaggaggactgcttgagccccagaggttgaggctgcagtgcgccatgatcatgctactgcactccagcctggggcaacagagtgagaccctgtctcaaaaagtgaaaataaaaagtgcacaaaggacaagaacagacacttctcaaaagacaacatacaggtggccaaaaaacataggaaaaatgctctacgttactaatcatcagagaaatgcaaatcaaaaccacaatgagacaccatctcataacagtcagagtggctattattaaataaaaaaaaaacacatgctggtgaggctgcagagaaaagggaacacttatctactgttagtgggaatgtaatctagttcagccactgtggaaagcagtttggagatttctcaaagagttaccattcaacccagcaatcccactgttgggtatatatccaaaggaaaataaatcactctaccaaaaagatacatgtactcatacactcatcacagtgccattcacaacagcaaaggcatggaatcaatctaggtgcccattaacagcacaatggataaagaaaatgtgatacataaacactatgaaataccatgcaaccattaaaaagagtgaaatcatgtcttttggagcaacatgaatgcagttggagggcattatcctaagtgaattaacataaaaacagaaaaccaaataccacaggtttttactcacaactgagagctacatattgggtggacatggacacaaagatgggaatagcagacactggggaatacgagggggaggtaagaagcagggagtgggcaagagatgaaaagctagctactgggtaccatgctcactacctcggtgatgggatccatcataccccaaacctcagcatcatgcaatatacccatgtaacaaatctgcacatgtaccccctgaatctaaaataaaagcaaaactttttttaaaacagagagaagtagagcctaaagaattataaattaactgattaaaaattaactgattttctgcaatctcatgataaaacttgaaaagatgaggagttgcttcttatgaatgaacaaagaaggtggtttcttgagatggaacctactcctggtgaagaagctgtgaggcatcatatgttacagtgaaatcatttgcgaaaggaagaggcaatcaatgcggcaaattcgactgttgtcttattttaagaaattgccacagccaccccaaagttcagcaaccaccacttgattagtcagcagccatcaacatccaccagcgaaaagatgatgatgcactgaagggtctaatgatccttagcagttttagaaatatattttttaattaaagtatgtacattgttctgttggcataatgctactgaacacttaatagactacggtataatgtaaacataacttttatatttactgggaagccaaaaaatttgtgagactcattttattgcaatatttgctttattgtggtagtctgaaactgaacctgcaacatctctgaggtataccggaaaatgcaattgcatatgtttatttaaccaaaacccagctatatttcatgagttttatactcacaagtttgaagacaactctgccaagaagtcgaacggagtctggaggatatctgggtttgcagcttttaaggcatttgcattcccgcttgtggtctggccaagcttttttctattaaaacaagagtggggagaacataggtgacctaaaatttaactttcatttatactggttttgaacatcaagagtcataaacattaaattttaatagtccaaatgtaactgcacaatagaaaataaaagcaatattctaaatctgaaaataatccaggatgagtctttgccaaatatgcaattactatgcaaggacattaaaagcctcagcttcacctctgtgctttcatttgtcccctggttattacctggctagtggagtccaaagaaagagccattacagcttacttaataatgtataagatggtcttggaactgattaaacaggattcaacaatagtcattttgaatacaaaaggaaaatgtcactccaaattagaaaataaaacgtggttcagaagactcaaaatagggatgacagccttctgaatttctgtgctgctacagaaatatcaggagggctaacacacccccaaatataaaatctctttgttttaaaagcaacataaaaagaactattagctaaaatcattaaatgtccagtttgtcctggatgtgtctaggtttgtatctatgtcctggcttaaatattaatagtgccccttttcactctgaaaagttctggttttgatgacaaattatatggtcacctaagccatgatcctagccatgtgttgatgtggctaaagagaccattgagtcagttgccaatgtacagatgaatggactaaagggaaggacactatccttgagccttggatcagaaaggcgacggctcctttcacacggaatcactttcatatggaaataaaatccagatcatctaatatttagccctggtgagtagaagaagcctcaatcaaatgtctctcgtgttatattctgaaaattggaatttccattactgaaatgcctgataccacttactcattcttatttcaaaaattataaatctgctcctcaatttctgggtctacaaaatcaatgtgctgttcataatttttgttttagcatttacacttcactcacttctaaacaagactgagctgattcaaagtaaagatgtgtatgaaataagactgcaaaaccagaaacagaacatattaaaattatggaagggggaaaaaggaaagcacgctagcatttacttagcattctacaaggtactagatacatggctaagcaaataacgaagcacgtttcacttgattttcgtaacaatccaaatggtaggtattatccctctattacaaataaaggctcaaaagctgatatctaactatcaaactgcccaaatacaaaaagagagagtaaaaattcttagcatgctaaacatgagagctgaataatttctgcattacatttgagtatttgtacgtcacatttatttgagatgccttacaagcaaggcaaaaaagaaggcataatggcttatataatcctcaactgacagaaagtaaaaacatacagtttcaccaagtattaaatcacaggagggatttattccaagaatgctaatcaacacactgaacaatgtccttaacaacagttcacaactataatggcctttcatatgacttctaatatcagtactcactgaaaggcataatattaaaatacaactcagtgaaagaacaagcttctgttgctcagggggctagtccttgactagcaattagcaattaccaatgtgtgtaagaggcctaaaatatacatggtacaattgtcaagtaagttttaaaaacacaatatcatgttgaccctacttagagattcaaaatatacttagcatcctaaaagttctaaaagtctatgcactaaagaaatgtgtataaattatttaacacagtttcccatgcttgttattgtcaccctttagagagttaggttggtattcactaactcagatatatctatatattttttttcacctggtctttgtatgtgagtgggttaagctaacaaatttacattcatttgcactcacaagaaacaagaatgttaacttttttggttttttactgatagaagggagaaccataactttggcgttagttttcctttgattatagaagttgagaaacctgtcagatgctctcatggacagagcgtgtaggcaggaacggataacatagtgccagtgggtctatcagaaagtaccttaggctctgttcaaatgcctcagtgtccagctgaacagggctcacactcagcaaaacaaggcagagataatttgaggcaaaagaccttaagagcagattttaatcaatgctcattttaattacaagagatcatccataacccctctgttaaaacctaaatatttgagcagctcagcctcctgatagcttaccagggtgagataagtacaaaacgtacaccagataatgaacaaccgatcagttagatgacagcatttggaattaaacatccaaattttggaaaattcctgttaaaacaactttaggtccttaacataattgatatagagctccttttctcaacaataactagaaactagacaaaatgtttcttaaacttattcctagatcattgcctgaaaacatacttattttctcatttgcttcagcaaaaatatgttcattatttccatgaaaagccaaatcagatcatttaggcataaatagagaaagcaatcataccacttaaaattggtctgtaatatggtaccacatatcagcccattccttttctttttaaaacattaactgttaaaatttatcattcagcttcacctatcacatcttaccataagggttacgaatacaagcataccatagaaaaggcttacaaagaaatctttttacgcagctcctttgactttgaagcaaaacgtgacaatcatacaaaaacaaaaggcattatcttcactcaacaaactaaccttggtcaagacctcgatgacacatttgtcatatatatttgccaatttctcaaaagacaaccttcctgatttacattttttcctattttcttacattacttccaatacaggatataattaagattttgctcataacattggctgtagtattttcttttgtcatagctgaaaattaacaatgatgtacaataagcatgaactggcttgagagacaaaggaaattaaaatactacattaagaagtaaaaacaaaaggagacaagagtttcatgctggaaaaaaaggaaatgacatctataacacaattctttcagtgcatgcatgactcaaaaaacaacttcagaatctatacagtttcataatgtatttttatagtatttataacagttcacgacataaactcattaaccacaccagtagttctcaatgggagtgacgcctatcttgagggttgtttgagaaatttatgcgggtatttttatttgtcacaaggtttatggaaaattacaggcacttaatgagcaggaaccaaaggagccagacattctgtgtcggacagttctccacaatgaagaattatccaaatccaatgcaactttcaagtgtccaaccaaattccatgacggtggaaaacttgtttataattgtctgagcctagaactaaatctccttttacatttaaaaacaaagagctcgtttttacataatcctaacagcactgaattttctaggtaaatcaaaggaagactgtattttaagaattttacctaaattactcaattaaagccatatcactgaaggcaacaccacttagagtacttgagttaccaatacaacacggcttctgacccgcatctctacttcccttctcacagtgactctatgtataggtgcaaatatgtgactaatgatgtcttccagtctaatacctcagcatttatatactaaaatacatattattttatcataggttttaattttctttttccttatattccaattatggcattatattaatgttttgaaaatatgtaactaggtatattgcactacctgtaaaatttcatttcaagatagtagagagggcaataaaaatagttctcacaaaaatggggagttgggtctgaaaagaactgagaagcccagatctaaaaaaatgctacacagttacacatgccacacacatacacaagaatatatttttaaacacatagcctaacacccaccctagggattctgacactacccatgagacagaatcaagcatcccactgcagggctgctatggtttcaatgtgtacctcaaagttcatgtgctggaaacgtaatccccagtgcaacatgttgagaggtggggtcgttcagtagcacagcgctcacgaacggattcatgtcactattgcaacagtgggtttgctataaaagagagtccggccctctcttgttccctctcaggagcacgctcccgtcatgtgacgccttctgccatgctaggatgcagcaagaaggcccttacagatgtaatccctcaaccttggacttcccggcctccagaaacaccagccaaataaacttctattgtttatgaatgacccagtctgcggcactctgttaatagcagcacaaaaacagatcaagacaagggcattccatgagtagctaaagttgaaaaaccactgagttaaactaaattacaaaggaggtcgttatatatactaaatagatgaaacaaaatacaattctataattatcattgaactattgttctatagaaataaatattgtataatattaaggtggaaaaagtgttttaaacagaacataaaatgtaaaaaccataaaggaaaataaatatatattcaattacataacaataaagaatttttgtcttgggggaagaaaaccagaaacaaggtttaaaggtaataaaccatgaaacagtctaaaatacatatatagacacagtgttaaatgtctccaatatacaaaaaggccttacaaataacttttgaatatttcaaaaaatataaataaaggtaaaggaaatgaataggaaattcatgactgaaaaagaaaaaccaatagacaactaatacaaaccacaccagtgctcaaagacatgataacagaaactagataacatagtgtcccattaatttggcaaaaatgaataaaactggcagtatttagaagcatctaggatttggggaaataggcattttccagccttgttagtagagttgtaggctgctctgatctttctgatgggtatttggtaatgaatatcaaaattgtaatgtgcatattgttgacacagaaatattattcataaagtaatttattttaaaaaatttaaatagtataaagaaataaatttaagaatgttccaccctaagcaacatagggaaatcccatctctataaaaaaaaattttttttagttagccagacatgatggcatgcacctgtattcccagccacaccagaggctaagaggagaggatcactcccagctatgctggaggctaagatgggaggtcgagactacagtgagccatggtcacaccactgcattccagtctgtgtgacagagtgagaccccaggtctcagggggaaaaaaaaaagaatgctcacaatagaagatgattaaaatactgaaagttaacttttccagcttttcctaaaagaaattgctatttttgtctttctctttatagctttccattactatttaaattttctacaaagagcatggagtttatgaataaaaacaaatataattttatgtgtagtaactgagaatcagggagaagtacttttatacgaaagggacagcaaaattactgtttaataggcactggtgcttcttaactttttaatgtttattttggaaatctagttgcaactcaaagcatgatttaaatgtgttaatttttaaatgttaaaaaatgcttcagtgaactgttctgtaatgctgatgcaatcttttttaattcagagattcactcagtaaattcttttattagtttggctatattcatgtctgtttttcttaaatgagtatagtaccaattaagtacaccttgcatgaaacaggtgttcaatacatattttatgatttattctaaaaccagtaccattcagggggtaaaatttactatatattatcattatttgaaattaaggccatacaaaaagaagaaatgaaagtagactctcacaattctttctttgaccaataagagatggtcttgattacatgattatgaaaggagtgtattgatgagatgttacactaataagagaaaatcaatttatttctttcttacgcaaaataacatttgcactattatcatatttccctctcctctttacatacaaagtccctattgctcactcaagaacccatttaaatgctgttaaacaccaagttttggttggagtggatatccattttagggtagctcattattgtttgggatagagtgtaagaagggtcatcctgtattgaaccttggattgggtaaaatacatccaattcatgacatcagctcactaggtatttattccataagaagattagattcaaagatctgcaaggcagtcttccaatgataaaattctgagtctgtaacatccattcctaacaaatatctgaattatgtcaaaataggtttgaaacctgcttgggttaggcttacaatcattgaaaatttgcaacagtattttcctcagctatttggtcattaaggatgaagaagctgtctttaaaaatatagaaaagaaaatgaattttttgagcccacttattcaacagtttcatataatattaactaaacatcttctacgtgaaatatcacagtgatttttttcctacatattcaggacttactccactcacaaacaatcatctacagaggtttcctatgggcaaaacttaggatagttgagctgccacgcaacttgcaggaaataaaagatactcgacagttttccatttacatccagtttgcttgatagcaaataaataatgcctcctcctttatccttgaaatgtagtccaatattgaattacagattgtcagatgcaggcagatctgaaaagctggaatctgggaaaagaaaactggaaggctaagcaggttgtctaacagctacagttgactgacaggtattgattaagatcttgcaaaaaaatctctttagagcacactagagattagtgatagatatgagacttctcactttaaaagcttactgaatgctgtatcaaatgtagagcaagagcatcttctcactagtcttaatcaaattagatgaatagagctaaatataaagaaggaatgtgccatgaaaatggtcttagggcataaggttgacaagaggaaaaaaagaacgtgaataaatgaccatttcttgggcaaatgggaattacggtctcctgttaagtgaggaacctataatatgagacaataataacaacagtgcccccaaagtaagtcaatcatcatctactgcagggttccaaaaatatatggctcataggtaaaattcattttacatttttacatttatgtaaaattcaaattcatgtacgttctaattcgtgctacatttttagtaaaattgtacattacagggatagagccacacttattagttacattcattcatttcatgctacatcagagttgaacacatacgacaaaaatcatatggccacaaagcctaaaatatttactatatagttctttacagaaattagccaatgcttgatctaatgagagatcatatgaagacgaaatgacttaattgatagtttggctggaaagcaaaataaatcatgcacttccacagacttccaatcttatttggaaaaagcatctatcctagattaatcaaaatatcaacaccagcttctagctgaatacggtaggtgagcacatgtattttatttcctcaaaacaagtaattatcaaattttttactcccaaagtgaactggaacagccatcaatggatgagtggcagggaaggatgtggttagccccatttgagagtgaaaaagtggtggtaagaggacaggctgcagaagcagggtcaaagaggccacatgtagggacagtcccatctgagagggaaggtcagcctgccaagcagaattccagaaaggatctagaatcaaagactatacattggtagaatggaattgaaaaatagatgagaaagagaaaattaaccacaagtctgtatgccaaagagtctcaaaacaccccttctctacttttggcttgattgagtaagcaatggaaggttaatgtacagaatcttgttgaatttgatgctaagattatctctgatccagattattgctatagcctcctatttggtcttcctgccctgactcttacccttctacaacggcttcttcaaacaatagtctaattctttgagtggcttaaaaattgtgatcactgtattacagaaaaagaaataaaatctatgcatacttaatagctctgtggtgaccaatatgtttcaaactacttacttgaaatataatttacattattaaattatatttaggttggtgcaaaagtaattacttttaatggcaaaaaccacagttacgtataataaaatgtatccattttaacagtatagtttgataaatttttgtttttttgagatggggtcttgctatattgtccaggctggtctctaactcatgagttcaaacaatcctcccaccttagcctcccaaagtgctgggattacatgcacgtgccaccacacccagctttgataagttatgacacatatatctccatataaccaacaccaaaattaagctacagatgttagtactccccaaaagttcccttgtgccccttacattcaagtcctccatcccaggcaactcagtggttttgtctctataattgtaagatcagttttgtctagcctagaacagtcttacttcttttcatctggcttcattccctcagtacagtgttttgagattcactaacgttgcggcatgcatcagtagtttgttcctcttaatggacaagtaatagtacagtatgcatctctttattcatttacctgtggatgaatatttcacttgtttccaggtttggaacattgaacatttatgtacaagttgtttttgtagatgtaagttttcataactcttaggtaaataactaggagcagaactgctgggtcatacagtaagtacacctttaacattattacaaactactaaactttcccaaaacaatgataacgctttactttctcaccaccagtgaacaagagttccagttgctccatcaccttgccagcacttgacaaagtcagtccttttaattttagtctttctagtgggtgtgtagtaatatctcattatggttttaattttcatttatctggtgaccagtgacaatgattatcttttaatgtatatcttcttaaagtatctattcaaatcttttacctgttttactcagttttcttactactgaattataagtattctttataaattctggaaacaacttcttggttggggtgagagagagagaaggagggagagaaagagaaaaggagggaaacagggggaaagagaggtctcaaatattttctccatgtctgtagtttgtctttccaaggagctgaagggtttaattttgatgaaaatcaatttatcaatttttcttggaggcttagtgctttctgtgttctacataggaaattttatgtaccccatatccaaagagtttctcctatgttttctcggttttatagttttagcctttaagtttaagcttattgaacctaaatcttattaaatctagtgaagaattgtttttacttttatcatttattttccatgtgcatattagcacaattttttgaaaagatcatcctttcattattgaattatgttggcacctttgttgaaaatcaactggccatatatgtgtagggctatagtttttatatttttatttctgaatacaggttgagtatgccttatttgaaatacctgggaccagaagtgcttcaggttttggatttctttggattttgaaatgtttgcgttatacttactggctgaaccatcccaaacctaaaaatccaaaatccaaaatactccaatgagcatttcctttgggtatcatgctggtgcttaaaatgttttggattttggagcgctgcagattttttgatttgggatgctcaacttgtattatgatgtgttgacattttaaaaacctttctgactaaggagaagactgctcctgctcctcccagggacagccaattctaagaaatagcaaaaagctcaatcctgagcatgcctttgataggcaaactaaatgatccacagccatacatcctctgtctggccctaacaccctaagaggcaatattcttctgccttaatcatcccagggccaggtaccaggcaaacagagaccacccttaaaccccaggatcccctgatattactcaaactagccaatcctaaactgagaaacacctatgaatgccacagtccagggacaaaggctcaccaaaaacccaagacctaatcatagaactatagaactggccgggcacagtggctcacgcctgtaatcccagcactgtgggaggccaaggggggtggatcaagaggtcaggagatcgagaccatcctggctaacacggtaacaccccatctctactaaaaatacaaaaaattagccgggcgtggtggcgggcacctgtagtcccagctcctcgggaggctgaggcaggagaatggcgtgaatccgggaggcggagcttgcagtgagccgagacgttctactgcactccagtctgggcgacagagtgagactctgtctcaaaaaaaacaaacaaactaaaaaagaactacagaacagttcctctcctcttacatcttgccatcacactactaaaggcctatttacagtggttccttttacatcacgtctagctatcaagaaaaaactataagacatactgtattagtacattcttatgctgctatgaaaaaatactcaatactgggtaatttataaaggaagacgtttaattgactcacagttccacagggctgtggaggaaacttataatcgtagtggaaggggaagcaaacacatccttcttcatatggcagcaggatggagaagtgcccagcaaagcaggaagccccttataaaaccatccaatcttgtgagaactaactcactatcaagagaacaggatgggggatactgcccccacgattcaattatctccacctggtcctggtccctaccgcgacacatggggattatgggaaccacaattcaagaggagatctgggtggggacacaaccaaactatgtcacatactaaaaggcaaaaaaacatagtttgaagagacagagcgagcattagtaccagactcagatatggcaaggatgttggaattatcagactaggaattttaaaaaactataattaatatgctaaggattccagtggaaaaggagacagcatgcaagaacagacaggggatataggcatagaaacagaaattctaaaaaccaagaagaactgctagatcaaaaacaccaacaaaaataaagaatgcctttgatatcttattggcagactggacgtagctggagagaagaatctctgagctgaaattatctcaatatggtaaccaccaacattaagaagcaaagacaaaaaaagactttataaaaaaaaaacagaatatccaagaactgtggaatgattatataaaggtataagatatgtgtaataggatatgtcagaagaagaataaagagagaatggaacagaagaaatacttgaagtaataatgactgagaagttctcccagattaatgccaggcaccaaaccacagatccaggaaactcagagaacaccaagaaggataaaagtccaaaaatctatacttaggcatgtcattttcaaactacagaaaatcaaaagttttttaaaatactgagagaagccagatttttatagctaaagataagtatatgtctgttttaggtgtttatagatactgaaatggtttcagtaatatgtcattttctgaaaatctcaaaacacttgaaaggtgtgtgcaatggtttgaaggtctgtaccctccaaaactcatgttgaactttaattaccattatatcagtgttaagaggtgggaccattaagaggtgactcagccatgaaggctctgtcctcatgggcaggattaattccagtatttgatgccctcttgtctcctggcccttccaccatgtgatgtcacagcaagaaggccctcactacatatagccatcttaatatagaacttccaggcctccagaaatgtgagtcaacaaatttccgctcttcacttatacactgatggtgggaatgtaaattagttcagccactgtggagacagtttggagacttgaactaagtcttgaactaccatgtgacccagcaattccattactgggtatatacccaaaggaagataagtcattctaccaaaaagacacatgtacccatatgtctctccctgcgctgttcacaatagcaaagacagggaatcaatctaggtgcccatcattggtggactgaataaagaaaacgttatatatatatatatatacacacacaccatcaaatactatgaagccataaaaaagaataaaatcatgcccttgggccgggcgcattggctcatgcctgtaatcccagcactttgggaggccaaggcaggtggattgcctgaggtcagcagttcgagaccagcctggccaacatggtgaaaccctgtctctactaaaaatacaaaaattagccagacatggtggcaggtgcctgtaatcccagctactcaggaggctgaggcacgagaattacttgagcgtggaaggcagaggttttagtgagcctagatcgtgccactgcactccagcctgggtgccagagcaagactctgtctcggaaaaaaaaatatatatatatatgtcttttgcaacaaaatggatgcagctggaggccattatcctaagcaaagtagcacagaaacaggaaatcaaatacagtatgttctcacttacaagtgggagctaaaattgggtacacaagtgtataaatatgggaacaacagacattggagaatataaggaaggggaaggaggaggaggtgcaagggttgaaaaactaccttttgagtactatgcttactttttgggtgacaggttcaatcatactcgaaacctcaggatcacacagtatacctttgtagaaaacccgcacatgtacccccagaatctaaaataaatgttgaaaacaaattaaataaatttgaaacaataaaaataaatttttttctttataaattactcagtgtcagttattctattatagcagcacaaaacagactaaaataaacaacttacatatagaggaacaaagaatcatagccaacttctcagaaaccatgtacaagagagtggaatgaaataaagtactgagagaaaaaaaaattactaatctagaattctgtaccctgtggaattacccttcaaaagtgaagggaaaataaagactttttcaggaaaacaaaagttgaggaaatgtattgccagtagacccacccgcatgaaatgttaaaagaaattctgtagagagaaggaaaattataaaggttagaaacttagatctacataaagaaagaatgagaatcaaagaaggaataggtgaaggtaaaataaaaactttcatttttcttattcttaattgatctaacagataatagtttgttcaaaagactgctaatagcatcaatgtatttaattatgtatgtttatgtataagctaaataaatgacataagagagggagcaggggccgggcacagtggctcaggcctgtaatcccagcactttgggaggctgaggcaggtgtactgcctgagcttaggagttcgagaccagcctgggcaacatagtgaaatcccatccccacacaaaatacaaaaagtagccaggcatggtagtgcacgcctgtagtcccagctatttgaggaggtgctgaggaaggaggatgagttgaactgaggaggtcaagtctgcagtgaggggtgttcaggccactgcactccagcctgggtgacagagagagatcccatttctaaaacaattttttttaaagagagggagcaggaattaaaagtattttgttattctaaggtactcattctacctgtaaagtggtaaagtgttatttgagagtaaacttggattcgtcgtaaatgtatattgcaaactctggggcaatcactaaaaaaggagatatatctatatctgatgttctaatgaagagaaaagaaatcatacaaaaggctcaactgaaaccacaaaaggcaaaaaatagtgaaagacaacaatcagaacaaataacaagggcaacaaatagaaaacagatacgataaatattaacccaactatatcaataatcactttgaatatcaatgatctaaatgcatcaattaaaagacaggaatggtcgcagtggatcaagacacaaaacccaaccatatgtcatccacaagaaacccattttacatataaatagattaaatgtacatggatggagaaagatataccgtgctaacactaatcaaaagaaaagcagaaagagctacattaattctagatttcaggttaaatgtcacctctacaggaaacccttctgtatccacctactcacaggtgagtttgtgctcaccccaatcacattcaatcatataatcatgggcatttgtcactgtctctctactccataacagaagctttatcaaagtcaggaccttatttacttgctcactgcctattacttatcataccaaccaccaggacttagagcataataatcactctaactcctgtgtagaaaataaattagaagttggaaagaatcgtagttaacaatgcagctaatccagaaaagagaccatggtaacaggtagtactaaagaagctgacgagaagggaaccaattcagatctttaggtagtaaaatagtaaaatcagcacgacatgatgactaaatggatctgtcgccaagaaaggatgagaatcggagatgacacctggcaactcagactgctgggtggctggtgaaactgttcactgaggctggaaaacatgaagggaagtgggtctgggggaagataatgtactcagatttacacgttacaccagagacgcctgtgcaacagccaagtggaaatcaggagaaaggaggctggagacggagtcttgagaaggattaatatacagatgccacttgaagtcataggagcagataacatcacacagcaggcaaaggtaaagtgggaaaagaaaaacttccggctccagacacctgtggaggtcaaaaactgaaatacgaccaaatcgttttaaacttcatgtagtactccctttgtgttgacagttagatacaaagctgacttatctacagtacattccgtgcaaagcctatcagtttcaggccgaatttatgaagtaaacaaagcttgacttccttcattatcactgctttggttatggtagtctaagaaccagcctattaaatcactctgttaagtgcttactaatgtgggattaattttctacccatcgaatatgaatcaaatcattccacaactaagcataaaatgtaaacccaaaaatacgattcacatttttaaagaggtctataattatcaatataaaatagagcttgtatctgctaatacagtgcttttaaaaagtatataaattacaatttgatggagtgcctaactccttattttgctcagcaattaattcattcaactagaaatgtatatattatcaatcatattaaatcctcaaaaggtaaaataatacttggtgaattacttgaaattgacttacttgctatcaccactgctgccattttttgttttgaaaatgcttttttataagaaattttagcctgctcctcctctttgatctcataatcatgtgtgatgttctgtttatagcaatagagaaaaaagactggacctccttctatgaaattatatgatagacacctgataataaggtatagaccagaatataaagccagtgatgacaaaaatattttgaccagtaacagaaacagtactgtacacaggagtaaatacatatgtcgatgtgtacgctatatatgatgcataaaccaatagtttggtgtatatcctccatccataaaatagacacatatggattatctctgaaaaacagaagtagaagcgggggaaggaagctggggaaagacttttatgttttaccctgtatgattctatatggtgtttttataataaaaacatatccttgtattgcttatgtttaaaaatgaaatgtgcaccagatgcggtggctcacggctataatcccagcactttgggaggccaaggctggcagactgcctgagatcaggagcttgagagcagcctggtcaacatgatgaaaccccacctctactaaaatagaaaaaattagctgggcgtggtggcacatgcctgtagtcccaactacctggggaggctgaggcccaagaattgcttgaacctgggaggtggaggttgcagggagctgagacggcaccactgcaccccagcctgggcagcagactaagactctgtctcaaaaaaaaaaaaaaaaaaaaaaaaaaacataaagaaagaaatgtgaataccaatagcactgacaccatcctgtgggcacaaggtacatgttacacctgcaataccccaatagcctctctcagacaacttgatgccatggtcccacacatcaaatgctaagctagtgaaccaaaatcatgtccccctggggtatacatattatggattttatactacagatttacatcctctgtttcaatttccattccaagtgcttttgcgttctgttcatcactgttcacagttcagtatgtcatttaattttgcgtagttttgtgggtatccacaataattacaatgtttaatgttgtattttaaggttgagataaacacagcagtttaaacgcatatgttctggccaatctttaactccccctccacacacacaaacacatactctagctgttattacatatatccttcatcttgctagctgttttcctgttaccttccacagtatatctgacagtgacattgttattgatgccacagtaaacagctaatatatgtagtaaaaacacatgcactacaggtaatcaaaatgacatacccacccaccaaactcctgctactcattctaatcagataatggcttttctcttccctgagtgtactacaaaaggatgatgtggcactagaggaaaaatagtcacaaaacaggggaaaaaaatgttttattaagtaaactgtttattaagtgttttattaataaactgtttaggtcattgagattagaaagcaagtttgcctagacttgtgtcaaataatatgataatctgtcgcttctctatgtactctgtttaatctgaagttcctagaaacaaatagctgagcttcacgtgaataaaacacctagaacatcaccataaaccaagctttctggaacgaatactgtataaaaagcagtattaatgtttcactttttgcttttagttactcttgttggtaacaatcttacataaatcagggatctttctagcttcgacaaaacttttgtttaaaaaatgaggtagaaataatattattgttttgaaatttcctatcctattttaattagaaagtgttatactggctgggcacagtggctgacacctataatcccagcactttgggaggccaaagcaggaggatcactagagctcaggagtttaacatcagcctgggcaaacagtgagatctcgtctccattaaaatttttttttaaattacctggccatggtggcacgtacctgtagtcccagtggctcaggaggcagaggcagggagaccgcttgaacccaggatttcaagactgcagtgaacttgataacaccactgcactccagtccaagagacaaagcaagactgtccccaaataaaaacccaaaagccaagaaacaaaagaataatacaatatataatggaaaactagacctaatcagaatgttagagcaagaacagaatttaggtttaaaagagcagttaaaagtctgaatacctgggtttcattcctgaaacttcagagcctactagttacagaatatttggcaagttggctgtctctctgtcctcattgtccttattaataaaataaaaataataatagtacctaattctcacaagactcttggaaaatcaaatggaataatacagtgcctggcacacagtggatgcctaataaatattaactcttattgttagtacagattcagaaactgaggcccacacagtgtgtgttttccctgagataatttaaccagcaaatgccagaattagcatgagaacctggaacccctgatatttttgaacttttgatttcttttccattaagaccactttttgtgtcgtctcaaattactttcaaaggataaaatgagagagaagaaaacccctgagacaagcatggcctaaatttaaaagaaggaaagaagaaactctggaggtgtgtgtgcatatacaaaacataagaaacaaaaaggatgagtggagggtggcagggaggaggcaagtgacatagacacaaaacctctaattagacttttaataagatgtaactcattaggacataattacatttcttattaaatgattaatcataaggttagaagaaaaggtcatgctgaatgttaattatacatcctttcaagaatttcaaagatgttaacaacagtactcgtaaattaactcaaactcttggcaggatatttggcattatctttaaaaattcaaaaggcatatatcctttcaacaatcaatacaataagaatttatcctactaataatttggggaagtgtgcaaaatgtgcaaaacaggatgtgaagtgcattattggcaataccaaatattagaaaagtgccaagcattcattaacaaagaaattattattatggtcaattcatacaatgaaacatatgggatacaaaatgttccccaaagtagatcgttaaatgaaaaaaaaaaagtacacaagaattcatgccagattaaactatatctttttttttttaaacataggatgtagatacacaaatatgtctgcacaagcaaatgctgcaaagacacatgagaaacttaacagtgattgcctgtggaaatgagaattgaagtcggggggcaataagatggggaggaatagacatttactttcacatagtagacatatacacacacacacccaatttttaaccatatatatttaacatcagttttaacattttaatgtccctggcaacctgtgtgactcagcaggtgaataacaagtaaaagtaaattaaaggctgtaaagaagtagacacaggccaacaggtatagtgaaggacaaatttaagagtaaagaatttgaaagcttcacttatatatggctgaaaagtcttacctgacacttagcactacagtatttggcgacgcggcactgagagcatcgcatcagcttttccttcctgtggggaaaaaaattaattctgcattaagaaatgagtgggaaacatagtacatagttgaagaaagaaaacataagtcaacatacggacacccgtatgttctgtttactccattatgtacagtcccttaagatttggattttcacactgatgagcctcctcttgaaccttccatgtgagacactgatagaaaaactaagtccttttgtctgacagaagatggcggggaagaggcaggaccagcttgcagctcccgatcggacagacagagcagcgtgtggggactcacactgtgaacttttgatccaacaactgccacagcaacataccaggtaaactaagagaatccacagaccctctgaaggaactgtatcgccactgcaggctccctgagactctgaaaagatgtgagctgcctgcttgctcagcagggaggctggcggtctggggcaagttctcagccacagtcaccagctgcctggaaacagactccgtgctgctgtgggggcacggtgggagtgagaccagcctttaggactgcgggctgtgtgggagtgggatgaggcctgtgactgctggctttcccccacttctctggcagcctgtgtgacccagcagaagcagccataatcaccctgggaacataactccattagactgaaaaccacatccccatcccaacagcagccgcagcaatccccagccaaggagaatctgagctcagacacacctatccctgccccctggtggtctttctctaccagccctgggtgccaaagacaaaggccataatctcttgggagctctatggccctgcctaccacctaagaaacctgaataggtaaccaggcgaccttagggcaagtttgcttcctccctgtaggaccacagctgatgtgttcctgaaagcaccaactcctggctggaggccaaccaacacaaaaccagcacactaaacaaaaatacaaccaagggcccttgtagagtccacttcacgcccctgctacctccatcagatcacaggactcttagcagtcactccccagtaccagcccagagcccagtacctccactgggtggctagacccagaagagcaaaaacaatcactgcagtttggctcttgggaagctccatccctgggggaggagggagaacaccacatcaagggagaaccccttggaacaaaagtatctgaacagcagcccttgagtcccatgtctcccctctgacacagtcacccaaatgagaaggaaccagaaaaacaattctggtaatatgacaaaacaagctctttaacaccccccaaaagatcacaccggctcaccagcaatggatccaaaccaagataaaatatccggattgcaagaaaaagaattcagaaggttaattattaagctaatcaaggaggcaccagagaaaagtgaactccaacttaaagaaatcgaaaacctgatacagaatatgaaaggaaaattcttcagtgaaatagcataaataaaaaatgatcacaacttctagaaatcaaagaaacacttagagaaatgcaaaatgcactggaaagtctcagcaacagaatcgaacaagcagaaaaaagtacttctgagcttgaagacaagtcttttgagttaacccaatccatcaaagacaaagaaaaaagaatttttaaaaatgagccaagcatccaagaagtttggaactatgttaagcatgcaaatctaagaataattggtgttcccaagacaaaaaaaagaaatctaaaagtttggaaacattatttgagggaataatcaaggaaaacttgtctgaccttgctagagatctagacatccaaatacaagctcaaagaacacctgggaaactcatcacttagacacacagtcaagaggttatccaaagcaaagatgaaggaaagactcttaagagctgtgaggcaaaagcatcaggtagcctataaaagaaaacctatcagagcaacagcagatttctgagcagaaactgtcagaggcatgcatgtgaaccagggcaactctatcttgaataggagctgagttaaatgaggctaagacttactgtgctgcattcccagacagttagggcattctaagtcacaggatgagactggaagtcggcacacaatacaggtcataagtaccctgctgataaaacaggttgcagtaaggaagcctgctaaaactcaccaaaaccaagatagtgataagagtgaccagaggtcactggtggtcctcactgttacactcccatcagtgccatgacagtttacaaatgccatggcaacgtcaggaagttaccctatatggtcaaaaaaggggaggcatggataattcaccccttgtttagcatataatcaagaaataaccataaacatggacaaccagcaggcctcggggctgctctatggagtagccattcttttgttcctttactttcctaataaacttgctttcactttactctatggactcaccctgaattatttcttgcatgatatctatgaaccccctctgtaacaaaaccctataagctagaagggattggggtcctatttttagcctccttaaacaaaacaattatcagccaagaattttgtatgcagcaaaactaagcttcataaatgaagtaagatacagtcttttaagacaaatgctgagagaattcgccactaccaagccagcactacaagaactgccaaaaggaactctaaatcttgaaacaaatcctcgaaatacaccaaaatagaacctccttaaaacagaaatttcacaggacctacataacaataacacaataaaaaaaacacaaggtattcagacaacaaacagcacaatgaatggaatagtacctcacatctcaatactaacattgactgtaaatgacctaaatactccacttaaaagatatggaatggcagaatggataagaattcaccaactaaatttctgctgtcttcaggagactcacctaacacataaggactcacataaacttaaggtaaaggggtggaaaatgacattccatgcaaatgggcaccaaaagtaagcaggagtagctattcttatagacaaaacagactttaaagcaaaagcagttaaacaaaacaaggagggacattatataacaataaaaggactagtccaacagtaaaatatcacaatccaaaatatatatgcacctaacactggagctcccaaatttataaaacaattactaatagacctaagaaatgagatagacggcaacacaataatagtgggggattttattattccactgtcagcactagataggtcatcaagacagaaagtcaacaaagaaacaatggacttaaactataccctagaacaaatggacttaacagatatttacagaacattctactcaacaactgcagaatgtacattctattcatcagcacatggaaaattctccaagatagaacatatgatagggcacaaaacaagtctcagtaaatttaagaaaatcgaaattatatcaagtactctctcagaccacagtggaataaaattggaaattaactccaaaaggaaccctcaaaaccatgcaaatatatggaaattaaataacctgctcctggatgattgttgggtcaacaatgaaatcaagatggaaatttaaaaagtctttgaactgaacaataacagtgacacaacttatcaaaacctctggaatacagcaaaagcggtgctaagcagaaagttcggagcattaaatgcctacatcgaaaagcctgaaggagcacaaatagacaatctaaggctacacctcacaaaactggagaaacaagaacaatccaaacccaaatgcagcagaagaaaagaaataacaaagatcagagaagaactaaatgaaattgaaacaaacaaaaaaaatgcaaaagataaatgaaacaaaaggctggttttgaaaagataaataaaactgatagaccattagcaagattaaccaagaaaagaagagagaagatccaaataagctcaactggaaatgaaatgggaaatattactgataccacagaaatacaaaagtttattcaaggctactatgaacacctttatgtgcctaaactagaaaacctagaggggatggataaattcctggaaatatacaaccctccaaaattaaaccaggaagatatagaaactctgaacagaccaataacaagcagcaagactgaaatagtaattctttaaaaattgccaacaagaaaagtctaggaccataaggattcacagctgaattctgtcagacattcaaagaggaaccagtatcaatcctattgacactattccagaggatagagaaaaagggaatcctccttaaatcattctctgaagccagtatcaccctagtacaaaaaccagggaaggagttaacaaaaaattaaaactacagaccaatattcctgatgacacagatgcaaaattcctcaacaaaatacaagctaactgaatccagcagcacatcaaaaagataattcatcatgatcaagcgggtttcataccagggatgcacggatggcttaacatccataactcaaatgtgatatgccacataaacagaattaaaaacaagaatcacatgatcatctcaatagatgcagaaaaagcatttgacaaaattcagcattcctttatgattaaaaccctcagcaaaatcggcatagaagggatacaccttaaggtaatgaaagctatctaagacaaacccacagccaacattacactgaacagggaaaagttgaaatcattccccctgagaaatgaaatcagacaaggatgcccacttttaccacttctactcaacatagtactggaagtcctagccagagcaatcagacaagagaaagaaatcaaaggtatccaaattagtagaggaagtcaaactgctgctgtttgtttgctgatgatatgattgtatacctagaaagccccaaagactcatccaaaagctcctcgaactagtacatgaattcagcaaagtttcaggatacaaaattgatgtacacaaatcagtagctctgctatacagcaacagcaaccaagctgagaatcaaatcaagaactcaatcccttttacaatagctgcaaaaaaataaaataaaataaaatacttaggaatacacctaactaaggaggtgaagacctctataaggaaaactacaaaacacagatgacacaaacaaatggaaacatgtcccatgctcatggatgggtagaatcaatattgtgaaaatggccatattgccaaaagcaatctacaaattcaatacaattcccatctaaacaccactatcattcttcacaaaactagaaaaaaaaaatcctaaaattcatacggaaccaaaaaagagaccacatagccaaagcaagactaagcaaaaagaacaaatctggaggcatcacattatccaactccaaactatactacaaggccacagtcaccaaaacagcatagtactgttataaaaataggcacaatgaaacagaatagacaacccagaaacaaacccaaatactgacagctaactgatcttcaacaaagcaaacaaaaacataaagtagggaaaggacaccctattcaacaaatagtgctgggacaattggcaagccacctatagaagaatgaaactggatcctcatctctcaccttacacaaaaatcaactcaagatgaatcaaagacttaaatctaagacctgaaaccataaaaattctagaagataacatcggaaaaacctttctagacattggcttaggcaaagacttcataacaaagaacccaaaagcaaacgcaacaaaagcaaacataaatagatgggacttaattaaaccaaaaagtttctgcacagcaaaagaaataatcagcagagttaacagacaaaccacagagtgggagaaaatcttcacaatctatacatccgacaaaggactcatatccagaatctacaaagaactcaaacaaatcagcaagaacaaaacagttccatcaaaaagtgggctaaagacatggacagacaattctcaaaagaagatatacaaatggccaacaagcatatggaaaaatgctcaacatcactaattatcagggaaatgcaaatcaaaaccacaatgtaataccacctcactcctgcaagaatggccataatcaaaaaatcaaaaaaataatcgacgtaggcacagatgcagtgaaaagggaacacttttacactgttggtgggaatgtaaaccagtacaaccactatggaaaacagtggagattcctaaagaactaaaagtaaatctaccatttgattcagcagtcccactactgggtattctaccaaaaggaaaagaagtcattatacaaaaaagatacctgcatacacatttatagcagcacaatttgcaattgcaaaaatatggaaccagcccaaatgcccatcagtcaacaaatggataaagaaaatgtggtatatatatacaccatggaataacactcaaccataaaaaggaacaaaataatggcattcgcagccacctagatggaattggagaccattaatctaagtaaagtaactcaggaatggaaaaccaaacatcgtatgttctcactcatatgtgggagctaagctatgaggatgcaaaggcataggaatgatacactggacatcggggactcaggagaaacgttgggaaggggtgagggataaaagactacacattgggtacagtgtacactgctcaggagatggatacaccaaaatctcagaaatccccactaaagagcttattcatgcaaccaaacaccacctgctccccaaaaacctattgaaattaaaaaagaaaaagaatctcagagaaaaaaataataacgcatggccctggacccatagatctccatgtactacaggagaatgctgtggtacgcacccccagcaccgcccccacaaaaaaatgtcctttttaaaaactttggtagaatatacgtaacataaaattcactattttaaccattttaagtgccctacttcacttcatagatactgatctctccatatcaaattcaaatccagtccataaactggttaaaagtattttatacccttcaaatatacaaattttgtcttaaattatcatatagtttaattatgaatatactcctcctgagaaatggttttaaaattccatttaattcaattactactttagacatgctgagttgagatgctttaactatctcccccaaatcacctgggtgacaaaaaagcagatatttttaaaaacctgaattatagctctccctctccctctccctctccctttcccacggtctccctctccctctccctctccacggtctccctctccctctctttccacggtctccctctgatgccgagccgaagctggactgtactgctgccatctcggctcactgcaacctccctgcctgattctcccgcctcagcctgccaagtgcctgcgattgcaggcgcgcaccgccacgcctgactggttttcgtatttttttggtggagacggggtttcgctgtgttggccgggctggtctccagctcctaaccgcgagtgatccgccagcctcggcctcccggaggtgcagggattgcagacggagtctcgttcactcagtggtcaatggtgcccaggctggagtgcagtggcgtgatctcggctcgctacaacctccacctcccagccgcctgccttggcctcccaaagtgccgagattgcagcctctgcccggccgccaccccgtctgggaagtgaggagcgtctctgcctggccgcccatcgtctgggatgtgaggagcccctctgcctggctgcccagtctggaaagtgaggagcgtctctgcccagccgccatcccatctaggaagtgaggagcgtctctgcccggccgcccatcgtctgagatgtggggagcgcctctgccccaccgccccttctgggaggtgaggagcgtctctgcctggccgccccgtctgagaagtgaggagcccctccgcccggcagccgccccgtctgagaagtgaggagcccctccgcccggcagccaccccgtctgggaagtgaggagcgtctccgcccggcagccaccccgtccgggagggaggtgggggttagcccccgccaggccagccgccccgtccgggagggaggtgggggggtcagccccccgcccggccagccgccccatccgggaggtgaggggcgcctctgcccggccgcccctactgggaagtgaggagcccctctgcccggccaccaccccgtctgggaggtgtacccaacagttcattgagaacgggccatgatgacaatggcggttttgtggaatagaaaagggggaaaggtggggaaaaaactgagaaatcggatggttgccgtgtctgtgtagaaagaagtagacatgggagacttttcattttgttctgtactaagaaaaactcttctgccttgggatcctgttgatctgtgaccttaccccccaaccctgtgctctctgaaacatgtgctgtgtccactcagggttgaatggattaagggctgtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgaccttccctccactattgtcctatgaccctgccaaatccccctctgtgagaaacacccaagaatgatcaataaaaaaataaataaataaaaaggaaaaagaaaaaaagagagagaggcaggaggcttagagtcagagaagtcaatgtggtgctgggatctgagaaaaagaacctggaagatggtcagttgctggctttgaagatggaggaagacactgaaccaagggatgcaggacaagctggaaaaggcaaggacacagattttccctggagcttcccagaggaagccaacatctggattttagtcccataagactcatctcagatttgtgagctccaggactgtaaggtaataaatgcgtgtggttgtaagccaaaaaaaaaaaaaaaaacctgaattgtaaaataaaaacaataaatctgatggtaaaattcacagtgacaaggatcagacgggactgtgtatagtttcaaggtggtcaagggctctaaaagtcaacctataatactaacatcaatgacaaaacagaacagctctttctaagcacttctgatatgacaggcacagtacgaagctctttacatctattaactcacactaaatttgaaacagttctgtataaggtaagcagtcttattatgccgactttagagatatttcaatacgttttcaaaagataaaaagtagatggagtagtacacactgctaaggcatcacaccataaagtgaaagtggcaggtgatactgaaaggataaaaacggaatcctatagagaatcagaacttgaatacatcaggtacctcacccctgaaagaacagaagtgagttatgggacgtaaaacatggggagtggttaaaagtctaaataaagcaacatcaaaaaattccatccacccccaagtgcagaactctagcttctaggtatcaatactccagcaacaagccaaacccaaacaatcgggccctagagttcttgattgtaaccacacaccacactaccattcttcagtgaaactggatacaatcaagtcaacacttagctgttcatgagacacacttcaaacaaaaggacatgcaatggtggaatgaaaaggatagttcagacaaatatgaactcaaaaaaagcctgtgtaactacataagtttctgaaaaaaagagacttgaaggttaaaagcattaatagagataaagccaatacacagtgacaaaagacttccatcaccaactgttacatacaaagtaaccaatatacccagtctcaaaatctataaagtatacatcacagatctctaaggaaaaaatgacccatatacaataagttaaagcagggcctggaatacagcaggtaccatataagagttagacattataaattctctttcagaaattcatagatctagaagataaagaataagtagataaagaagataagaataagaccagtctgggcaacatagtgagccctcatttctacaaaaaaaaaaaaaattaaaaaattagccaggcatggtgtcacaagcctgtggtcccagctacttgggaggctgaggtgggaggatggcttgagcccgagagactgaggctacagtgagctgtgatcacaccactgcactccagcctgagcaacagagtgagaccctgtctaaaaaaaaaaaaaaaaaaaaaaaattaggaatataagaatattactcaagattcagtcgggttaaaaacaagggaattctggggaaatgatggcagtgatgtaattttttaatctcctcgactctccccataaaaaaaaagtaggacagtaaaacctaatcaccactccccaccctggaaaacatcaataacaaacctcaaaatatgactgggtggaaaaaactatgagtggttctgagagcagaattaaatcagtatctttattgtaggaaacaaggcaacttaacttccaacagacctgtaaacaaggaggccccaaatcgccaaaagctgtccagcatagaatgccaagccaatctgagaaccgcagccaaaactgggagagggttctttctttagcaaacctctttaagatgaattccccagggctgctctgaaccctgccttccctagacctggctcctcagattttctcacttccctctctcttgtctaagttaatcagaggctatgtctgttggctaaaaataaagatccacaagtacatacaaaatgtttgttcttgattttaaaaaataacgagcagaatcaagatacctaagaagctcaggtgatgaacacctagcaaatatcaatccttcatttcctcctccctcccatagctaccaaaaaaacgctataataaatgttgacacagaagtttggtaaactaactaacaagataattcagagtacttgaataatttatgtgtcatttaaggtgtgatggcaattccttaacatgagttatttaaatgtttgggattgtttttacatattaaatgactaaataaataaatctaaattcttactttcaaaaaaaaggcaagttgagtccaagaaaaaagtgatgtgtgcttgattaaaccaactactgaaactttgatatgttactgcttttctctttggggcatggttcagagcagcagccccctggcaggctcccctgcagagaaaatacttgggcagcagtgagagggaacaggaggtcagcagaaacacagccaccagacagtacgagaaaaccttctttttctcttaaaaaaaaaaaaaagcaagagggccacatctgtaatttcaacctcagtgacacgcttggggagcatagaatcatctcaaaaacaaaattggccaggcacggtagctcacgcctgtaatcccagcactttgaggtgggcggatcacgaggtcaggagtttgagaccagcctgaccatggtgaaaccctgtctctactaaatatacaaaaattagccaggcatggtggtgtgtgcctgtaatcccagctactcaggaggctggggcaagagaatcgcttgaacctgggaggtggaggttgcagtgagccaagatcatgtcattgcactccagcctgggcgacagagcgagactccatctcaaaaaaaaaaaaaaaaaaaaaatcaccacatgtcatttcaaattgaacaacaaagccgtattttttggggaaaaaaagagaaatgtctatgtcaaatcaaaaacataattaattagcagtttatagaaaaaggaccacttattttaggtagcttcagaggctaaaacaagaaatagtgaatggaagttagaggagggcagattttacctaaattgtaacgatttttctggtgacagcaactgttcagaagtctaatgcaatgccttgagaagcgtagggttcccagtgacttgacatgtttaaggagaatctagtagtaagtatatttgctagacatgaggtaagagaatttccagtattgcaaaagagaaggagttagataagttttcttccaactccaaaattatttggttttgtttctcttgtgcaaccaataaatataaactaaatttgaagatgacagaaattgtgcatattttaaggcaaagtatggtggtctcagaaaggtagagaacatgctgtttgcagagtgtttgtctaaaaagtcgatccagaactggagtttctgaatgaaaaaccgcaacctctgcctcccgggttgaagcaattcttatgcctcaacctcctgagtagctgggattacaggcgtgcacaaacacgcccagctaatctttgtattttagtagagatggggtttcactgtgttggccaggctgctctcgaactcctggcctcaagtgatccgcccacctcagcctcccaaagtgctgagattacaggcgtgagccaccatgcccagccaaaaaataatcttaaaaaaataagtgaggaatgtatcagtcagagaaaagtgatttttaccttttttcccttcatttcaaagatgaatattagcattgtaccaccaaataagagaagatattgatattattttttaccaaaataaatgggatcgttagcaacccaccctcttcaaaaaaagcaaaaaggaatcccctatcacttgttcatacaaacctgactctagagaacggagtgtcatatcaaagaaaattcttaggttactcagtgtcccagacacagtggttcatggagcacaagttaagtcctctcttctgggtataggctgggccataattagtttctccaacagcctaagctactgaaatgtaaaaagaaaataaaaactgggcaaaattaattgttcttcagtcttccagtatacaaattaaaaacttagatatgggtatagcaggaacaaccatctctaagaaatttttaagaagtggggcgtgaaattaattgagtcactcaaatctcaactatgggggtactatcttagggaccatctctctatccttcttgggtgtcagagggaaagagtatgtccatgtttagaaactctgtgctaaaaccataaaaccagttaccagacagtaggaaggaagtttcctggaatggatatagaaaacaaaaaaatcctagtgactcccaaattccccccagccctgggacccacagaatccactttaaacttcctatagagaaaaaaattcatctacaacacattcctatataatcaactcattattcagagctccttcctagtaacatgtcttaattacctaaaagtctctgtgatggttaatactgagtgtcaacttgattggattgaaggatgcaacatattgttcctgggtatgtctatgaggttgtggccaaaggagataaacatttgagtcagtggactgggaaaggcagaccccccctcaacctgggtgggcaccatctaatcagctgccagcacagctagaatcaaagcaggcaggagatcgtgaaaaggctagactggcttagtctcccgacctacacctttctcccatgctggatgcttcctgccctcaaacatcaggctccaagttcttcagttttgggactcagactggcttccttgctcctccgcctgcagatgacctatattgggaccttgtaatcatgtgagttaattcttaataaactcatatatacagatagaaagatagatagatattccattagttctgtccttctagagaaatctgactaatacaaccacttagcagctgtgtaatactaagcagtttaacctctcaaaaccactgaactaaaatgagcataaataataataataacattacatgggccctgagatttaaatgaaacttaaaaacttaatatcatgcttggttcacagaagtgctcggtaactattactcattatcatcacagttttactattattttaagatttttaaattgcaaactttcaagatgtttctagatatcatctgaaatatcttagtactaacagattaaacaatactaatatattaactagtttagccactgtacacaaattcagaattttataaacctttgaatgtttataatccttagaatatttttcctagttatttttgggaaaatttcagaatttttaaaaattgaagtgattacacccaccatccacctatcaaatggctattaacacacaccagtagatgtggtcaaaattgtacagactcataggaaaatagaattgatttggattcatttttctttcttttttatttttgagacagggtctcgctctgttacccaggctggagcacaatggcacaaacacagctcactgaagcctctacctcccaggctcaggtgattctcctacctcagcctcccaagtacctgggaccacaggtgcatgccactacacttggctaattttttaaattatttgtagagacagggtctccctatgttgcccaggctagtctcaaacttctggactcaagcaatcctcccacctcagcctcccaaagtgctaagattagaggcgtgattagattagagccactgcacccagcctgggattcctttttctacattccatttcatcttatttcacatttctaacacaaagtataaaacaaaaaaaaaaatgtaatggttagtatttcgaggaaaattaatctatacttcactggcaccataccttcctaggagaaacacaagcaccttaaatccagcactttgggaaaagcacagcaaaatatgtggacccagttagaatccgagaggcagaccagctgcttgagtactccccttccactgtctgcaaccctctaaactaaagctaatatccttgtggagcctgtgccatctgataaacacaaaccccaggtgtgaattcaacaagtgctcagcaaccggccaccatgggcatcatcgcataacgtcccgggtggatgacagtggagagggtaatgcagtcactgcttcttggagatggcaatcaagaaaggcagaccaacacacatcacttgcagaatgaaccataatacaaaaccattttttgagaagtgacacagactatacaggaccccagttcaggtgaaggaaatgtcactttctgatgaataaagagtgagtggcagagaatggtaggactattttgggggacaaggaaataaaaggttttagtagtttagggttcaaaacctgcaatacttactaggggcgtacccttgtaacatcttgtagcctcaatttcctcctctgcaaagtgggaataagtgacttactcacgggactgcaaggcaaactatgagataatctatatggagcgcctgctaacacagcaccaagcaaagtatttagtgcagagttaaaactgaggctgctgggtgtattctcaaattgttcaggatagttttgtccatctctatcagaaaagtttcttctatatcacttccatggttactaaaaacggaaaaaagctacatctacgtgtgtcacaaatgtcgtcatctccacacaggtacacagaccatttattaataccactttttgaaacccacatgtagccagactacttggctctaatttcaaattttgactagtatcctaagtatttgatacctcaatctacattcactgaagtcataagttttaatgtgatcagaataactgacttcaaagtggtctaattcaagaagctccaactttaaagttgtaaaaatgctttttgaaggttgcatttgtagaaatgaaatttgaaaagactattaaatattcaataatattaaaaggcaattacaactcctaacattctgtttgctttaggcaaggtaatgtctgtaacaagctaaggagcaaattaaaacgccagggtccttatgttttataacaacacggttctaaactctcctcatcatactaacagtatttaaaagattatacactgcctgttgtaagtcactcggacagctaatcattggaaataagtgaattaagaatcggtattaaaatacactggcttgtttttcaggtggagcacagtgagtagactggagaaagctgtgaccaagatgaactgcagaaaaggaagttttttctagtaacaacacccgtccctaaataagcaacctcttcagtctagtctagtaacacaactctgatcatctaagagatgtgttcaatttccctaagtcttcttgaaatctaaaataatttttaaaaaatgaggaagaagaaaaaaatctgatttttcccaaagattgaaatcaaacaccctttaggtgtataactattgctagtacaaatatcacagtaaatacatttttaaaaagtaccatgggtaaaatttcaaataaggtataacaatatttgatcaatattttcataacatactatgacgtaagccttcaaaatggcaacagatgcccaccttgagttcagttccagaaaatattttgtcactctagaaaaattctctctcttacttcctccaattagaaaacaacacatcagcaccatgcttccacttcagcttcgggggtgggaaaatcaaaagctaaattcactaattggagtcgtttgttcatttaagaggcctgaagccatcttctccttctgcctgctttaaatatttgctcttctgttttacaattatgtataatactttgtttaacttttaactgtaaattgcctcaagtctccttggaactaagcaatgacaaaatctcaattaattcattctctcttttggaaaataaaatgacactttaagtttataaagaaagactagcatgctgcctagttcctaagtaaagaaaccttcaaagaagaggccttaagagacatggaattaaatgttacagctgcaagtgcactataattaattacaaattctcatcgatttttattaagaggtcaatcatctgctgatagccatggaacgacagttaacgggggttggtgcaagcactttgatgcctgctgaccctcctctagtgagcatgttgtatgcccaagagaaggctctccatggccctaaaataccactcagatatttttcttatcaaacacccatctgagtttgagcatatctttttattctatttttttagcacatgtctgtagcagccagagagtttaagaataccttgagatgaagtatagacatccctctaaaaggctatgactacaagtcatttgcacttagtatgaattaatttattcagataatcttacttcctttttccacttagctgagattttaggaatagagattttgcatagagtaggtacagaaagaggagataacagtgctgaacatttaaaaagcctagaaagaagcctgtaatcccagcactttgggtggcggaagtgggtggatctcttgagggcaggggttagagactagcctggccaacatggcgaaaccccatctctactggccagctgcagtggctcacgcccgtaatccaaggactttgtggggccgaggcaggcgggtcacctgaggtcaggagagaggagaaaatgcagtataacaaaaagggagttagaatgtataagaacatttcattttccataaagtttggagtcaggcccaacatgctctcaagtatgaaatacagaaagtacaaggaggaggaaaaattctaagagaactgaagagaactgtactttaagcctggctgcttcatttactgctctccatctacaggcaatgaataaatgtatccacccctaaaggtattctaatcataataataaaagctacctagaatgtcaaaaggaattttcatatcacatatacattgtaaaattaagttttttcaatgtattaaaaaaaagactgaaaagaaatagaccaaaatattgatttttttctttaaatgatacgaattggggtgatttccccctccttttattttttccatttttcagttttatataacaagattattttacttccatgatcaaataaacataaacattaatgaaaaggaaatatgtattatttaacagccttaaattgtgtctagtctaacgcagggcatagagagaaggacagacagacagataggtatgtcagctttaattacaatttattccaatgtttagaatagtaaacacaaatatatactttattcaaacataatttaaattaaatattctttattaattgaatttatttctaactggcattagctacaaaggatgttatcaaatgaaatatttcttagtttttgataacatgagaagctgacaacttacaataataaaatcagtatcatatgctaaatacaaaaatctaatagttctggatttaatatcttccacaatataaaaagcaatcatttcagaaaagaaaccgttattaaaaagaagaaaagcttttgccatatggaacttgggttgctcagcctttttctgaaaagatgtctcaacttcatctgatggttcatattttatcattttctttgacttatatgaacttgaaggtcacccagataaagtaaaactttattcttttatattaacttttatttgatttggagttagtcaatcaaaacattacttgtttgaaaatatagacatggagaaatctttaacaagcaagatatgacagaaattaaaggctattccacaaaacaaccctgccattcattcactgattcattctttcaacaaaaatatactgacccccttccaaatgccaagcacttaattagaaacacagtgggcactgtccattgtttacccaaaaaccaccccactctttcctagcatgaagaaatactgtgatttgctgatgtagcaaacacagaactcttgatttcagggagaggagattgccagagccggggaataaatcatgattaatctaaacttaaaaaaaaaatgtatccctcatgggcactggccactctaagaacaagccatgtggcccggttttggctaatgacctgtaaacaggtacactcacttctcattattcatatattccatatttgcaaattcacttattcacttatatttatctgtaactccaaaatcaacagtcacagcatgtctgcagtcagttgtggacagaagaggaaaggccaaaaatgtgtgtcgcccaatatgtatgttcccagctgaagtcaaacaagaagacactgccttctcagctctcacagtgtaagcgtcctttttgcagaccacttggtgctctgtttttctcatttttctcgatttgactgtataatatggcccctaagcacagtaccacagtgctgtctcgtgtccctaagcacaagaaagttgtaatatatgcctcacagagaaaatgcatgttttagataagcttcactgaggcataagttatggtgctgctgaccctgagttcaatgttaatgaatcaacaatatatattaaataaggtggccgggcatagtggctcatgcctgtaatcccagcaggagtgtgaggccgaggttggtggatcacttgaggtcaggagttcaagaccagcctggccaacatggcaaaaccccatctctactggccaggcgccgtggctcacgtctgttatcccagcagtttggggggccgaggcaggcggatcacctgaggtcaggagttcaacaccagcctggccaacatggtgaaacctcatctctactaaaaatacaaaaatcagcagggcatggtggctcatgcctgtaattccagctactcgggaggctgaggcagaagaattgcttgaacttgggaggtggaggttgcagtgagccgagatcgcgctgttgcactccagcctgggcaacagagtaagactccgtagcaaaaattaaaaaaaataaaataaggtgtctttaaaaagaaacacataataaaacaaggttatgtactgatcaggtgacaaatatgttgtgactagaggctttcaggaacctaatcctgtatatctactaggaggaatgaatggctcagtattggctaattcagttttcacagtaactttataaaacatacctactggaaataataaaaatgaactacatttctaatgagagactttttttttttttttttttttttttttttttaccaattttcaaccttctcagcacaagacacaacatgagagtaaatgccaccactctgttacatcaaatagccaacttccaatttttggatgagaaaaataagttaactatttgtttaagccactacagtggaagtgtattcacaaagatgtaacaaaatggtgcttcctccttgtcagtaaacagtacagtggtcctgaaagaacacagcgaagatgttctacattctagcataccaagtcttacatatgctgcttattttctagtcaaatagagcagcacgtgttaatacttatatttctgcccttcaaaattaaggtcaaaagatcggcaataatgtgaactggctaaaatctaatttttttattgttgttgtttttgtttttgttttgagacagagtcttgctctgtcactcaggctggagtgcagtggcatgatctcggctcactgcaacctccgccccctgggttgaagcaacaatcctgcctcagcctcccaagtagctgggattacaggtgtgcaccaccacgcctggctcatttttgtatttttagtagagacggggtttcaccatgttggccaggctggtctcaagctcctgaccttaagtggtccaccagcctcagcctcccaaagtgctgggattacaggcatcagccaccacacttggccttaaaatccaattcttaataaagttttggactttattattacttagaaatatgcctagcttctcaaaaaaactattttgacacgtgataaaggaatgtctggaaaacagatatggtctgattaagatataaatatgatggtataaatattacagtattacatatatatacacacacagctctctacgtgtcttgctatttcatattgatagaaccgatcttatgttcatattgatggacattagtgttgataacaatgttttaagctattataaacaagcagggcacagtagctttgggagcccaaatcctagcactttgggaggccgaggtgagcggatcacctgaggtcaggagttcaagaccagcctggccaacatggtgaaaccccatctctactaaaaatacaaaaattagccaggcgtggtggcaggtgcctgtaatcccagctacttgggaggctgaggcaggagaatggtgtgaacccaggaggcaaaggttgcagtgagccaagatcacgccactgcactccagcctgggcaacagtgcgacactccatctaaaaaaaaaaaaaaaaaaaaactaaacataaataaaccagtataaacaacattacaatgaacacatacttgaactgtgcacttatacaattctttccaaaactttctggtctcagtcctgacttaaaaattactgaaggatcttaaagaggctttacttaggtcgacttctctactgatatttaatgtattacagattaaaattaagacgttaaaaaaataacgtattggccgggagtggtgtctcacgcctgtaataccagcactttgggaggctgaggtgggcggatcacctgaggtcaggagttcaagaccagactgggcaacatggtgaaaccccatctctactaaaaatacaaaaattatctgggcatggtggcgcacaactgtaatcccagctactcaggaggttgaggcaggagaatcacttgaacccgagaggcagaggttgcagtaaaccgagatcacaccattgtactccagcctgggcgacagaggctttgtctcaaaataataataataacgtattaattcattcaaaagtaagaatcctattacatgtcaacatattttaataaaaaataactaaatttttcaaaacaaaaataagttagtgaggaaagtggtaatgttttacttttttgataatccttttaatgtctggcttaatagaaagcagctaattttttttatgtttcttcattcaatctactgcaatgtagcttctggaagacccacagtatactcatgagataataagaataaaaaaggcaaataattctttttttttttttttttgagacggagtttcactcttgttgcccaggctggagtgcaatgacgccatctcagctcaccacaaactccgcctcccgggttcaagcgattctcctgcctcagcctcccgagtagctgggagtacaggtacctgccaccacacctggctaattttgtatttttagtagagatagggtttctccatgttggtcaggctagtcttgaactcccaacctcaggtgatctacctgcctcagcctcccaaagtgctgcgattacaggcgtaagccaccatgcccaaccataattctgaattattatcatgaaaatagttttcacttaaatccctgaaagtcccatgggtactcccagaggcctccggactccactctcattccatttctttaaagtatgtattcctagaagtaaaactgctgagttgcaagaaagcacaacttgaacaattttgcatattgacaaacaggtctccaaggcagctggaggaatttacactctcacagccatataatgagagttcccctaaatctgtatctcatcacctcttgataccgtcatttcacattctgccggtctgatgggtgaaaatgttatctcaatgtgctttcccttgacaaatggtcagggtttgagcatcttttcatgtctattcaccatgcataatttcccttttatcaactgcctgttcatagcatttgcatattttctactgagttttcttagtgaatttaatcatttgttgagtgcctgttttacaaactcatttctcacagactgtgtctgtatttcacaactaggcactatgaaagaatataatactgtaattaaatagcttacactagtgccacgtggcctggaattaaaatttagttgaccactgtgatggttgatactgagtgtaaacttgattggattgaaggattgatcctgggtgtgtctgtgagggtgttgccaaaggagatgaacatttgagtcagtggactgggaaaggcagacccacccttaatctgggtgggcaccatctaatcagctgccagcacagctagaataaaagcaggcagaaaaatgtaaaaagagagactggcctagtctcccagcctacatctttctcccatgcaatgcttcctgcccttgaacatcagactccaagttcttcagttttgaaactcggactggctctccttgttcctcagcctgcagatggcctattgtgagaccttgtgattgtgtgagttaatacttaataatctccccttcatatatatatatatacacacacacatatatatatacacatatatatacttaataaactcccctttatatatataatataatatattatatattatatataattatatataatatatttaatatattatatataatttaatatatttaatatattatttttatatattatatataatatatttatatagtatatataattatatataatatatttatatagtatatataaatatattatatatataaagcaatctccctgtttatagctcatttataacaatcctcagaaatggaaatttgtaattgatcaaccttgactaaacaagaagattcccaatggcaataaactataacatctatttccccccagagaaaatgagaaagaaaacaatattttatatatatattattaagtatatatatacttacacacacatacatacacacacacacacacacacacacacacacacatatattccattacttctgtccctctggagaaccctaactaatacaaccatttagcaactgtgtaatactaagcaatttaatctcttgaaaccactgaactaaaatgataataaataataataataacattacatgggtgtaataagaataaaacttttaaaaacttaatatcattcttggctcacaggagtgctcagtaactattactcattatcatcacggttttattattaagatttttaaattgcaaactttcaaaagctgtttctagatattatttgaaatatcttagaactaatagattaaacaatactaatatattaaacagcttagcctttctagaaaatcagaattttataaagctttgaatgtttataactcttgggatgtttttcctggttattttcaggtccttcacatatctaacaatgaaaaattactgaattaacgtaacagttgaagttattcgcagaagtaaccataggtatagctaaacagtaactacttcttagcctgaaagcaaccaaatatgaatacaataacaatgaacctaatgtttctggaaaaatcattaatccaactgacttttaaaagttttgaaaaggccgggtatggtggctcacgcctgtaatcccagcactttgggaggccaaggcggatggatcacttaaggccaggtgttcaagaccagcctggacaacacggtgaaacctcatctccactgaaaatacaaaaattagtcaggcatggtgacacacacctgtaatcccagctactcaagaggctgaggcaggagaatcacttgaacctgggaggtggaggttgcacctcccagggaggtcgagatcacaccactgcactccagcctgaggatcagagcaacactctgtctcaaaaaaaaaaagaaagaaagaaagaaaaaaaaaagttctgaaaagtcaacgtccatacccaaatagatggaaaacttctacacatttttctcatatctcagaaaaatattcagagataatacagtacattaaatacttttatttttctacctagataataaggaaggctgagaaaatcttaatgcatcaccttcatcctctcctatacacactaggctaatacgaatagttttcaatacaggagaaaaaagataattaactcttttcaggtaaactaacccatttcactaaaaagcaatctccctgtttatagctcatttataataatcctcagaaatggaaattcgtaattgatcaaccttgactaagcaaaaagattcccaatggcaataaactataacatctatttccccccagagaaaatgagaaagaaaacaacttttgaaatgtcattacttgaatgctttttaaaaactatgtgatattttaaatggaaaatgttaattatcttttaaagaccttcttctgaatgccatatccttcctattgttgctgttctttcattactggtcccataaatacactaagagtctttttgtaccatggctctggtaggttctggatatataaggatcaataagacagttcctattttcaaggactgttgatgctacgacagaggcagaatagcaggaacagcaataatgctcaccaagcgcctattatgtgatgtcaggttctgtgctagatacctgtaacatgcagttgttgaaaagtaggaatcttgaaattgagatatctgaagtaatagttactgtgctggggtgtggccatgggtatagccatgggctactgtcctaggctatggccatgggaagaggtagctagggtaaggtaaaggcaaagagaattggaagtggggacaaacagcccaggtgtcagatggatgctcaattcgctaagaatgatgttgccagtaatgataaagaaagaaaaagtgagccatgaatgttaaggaataactggaaggtgaggtaatggggagtagaatggcaaatgcttcagaggagctggcaattttgaggaagaggaaaaatggtgtaaatggatgaagaggagcaaaactgacactctctgactctctaggcctctagtcttaaaggacttactctcactggccagaactcagtcacatggccatgtctagaaagtcggaacatttcattctttagctgggcttactgccacctcgaataaaactgaagttcttttattaaagaagtgcccagcgaatatctggtagataaccagcagtttttccataaaaaaataaaaacaaaacctattatgatacctgaaattattttaacaggtataaatgataaacttgggatggcattaaagtgattaaagacactacctggtgagaaacagaggcgaacagagaccaagtttatcgatgcttttgtgtaaagttgcatacacaaaccgcaatcaagtcaaaacagaagacttgaagatgttctcataccatgaaggaagaccaatgaactcagactggtcaatgtactggaggcaacaaggacttccttagaggagtgagtacatccagtacctctttatatcgccatccatgtctcccgcagtgccctgcatattttatacagtgaataaatgtttgctaaagaaacaaatgtgtttacatatggaagtattttcaaccaggccttcaacaccaataactgttgacacttttagaagaaaatcaaagcagcccctgcagcctcagactcctccagctgtcacctatgggatccagcctccaggccaaccgcaggctccaggccagctcctgtagccccagacccctccagctgacacctatgggatccagcctccaggcccaccgcgggctccaggtcagttcctgtagccccagatccctccagctgacacctatgggatccagcctccaggccaaccgcgggctccaggtcagttcctgtagccccaaatccctccagctgacacctatgggatccagcctccaggccaaccgtgggctccaggccagctcctgtagccccagacccctccagctgacacctatgggatccagcctccaggccaaccgcaggctccgggccagttcctatagccccaaacccctccagctgacacctatgggatccagcctccaggcccaacgcaggctccaggccagctcctgtagccccaggattcagactgaaacccaaagactcagcctccgggcccagtccagccccatgtcagccgctacaactctaggttccaggctcactagaatgccaggtcagtcctcacagccctagactccaggccagcacccatggacccacgctccagcaaacccaggacccatgcccactctatagactcagagtccaggcctgcctcagtaaactcagcatccacagccttaggcaccaggctagcacctgtgaacccaggctccagaccaagccccgtggacccaggctcaccccagcaccaggccaatcccaggctctaggctggtccctgtgaccccagactctaatagacccaggatccaagctcattccagcagacccagggtccaagtccaccctggtcaaccctagtgccaggttgccccacagatccaggctctaggattgcccctgtggacccaagatccagacaggtccccacaggcccaagaaccaggtctctttctgcatactcaagctccaggctcaccccagcaccaggctaacccccatggactcaaactcaaggcccatccacatggacccaggcacccagacaatcctagtgccaggctggcccccacagactcaggctcaaggcccactccagggccaggctggccagacttcaggccagcccctacagacacatgctccaggctcgcacccatgagctcagtcaacagactcacccagtggacctcaccaccaggtttcccccatggacccggggtctagtccttcaaacccaagatccagacctgtcccagtgggcccaggctccagacccacccccatggacccaggtcccaggcctgcccacctattgacccaggcacaaggctagcctgcccaagaacttgaggtagccctccttccctcaggaggcggaaagaaggcaaattaccttacaggcatgaaagacaccaaaggaatcatcaacttggcctctgtttacacagcaggatctaccagctgggaatgcatttgaatgagtgttggggatgggtagatcagagatctcaatattcagtaaaaagaatctttctgagaacgttctcctcccaaaagggcagaaggccacaactactgaaacacaaagcctgacttcatttgagagactgactccaccccagaccaatgaatcagaatctacatcttaatcaaatgtctaggtgattcatattgcactaaaggtagaaaagcactggtctaatatacaacaacaacaacaaaaagccatatctgaaatggaattacagacaattattttggatatgaagcctctttggtttaaaaatgcattatcctttaaactgcaggcagcaagaggtaatacatcacatgaaataaaagctgttatgatgctttttggaagatgatcaaaatatcaagatggggtcaggcatggtggctcatgcctgtaatcccagcactttgggaggccgaggtgggttgatcacttgaggtcaagagttctaccaaagttaacaaataactcctttcagcaaaaccctgctcctttttcttaggccagaataaatgccaacatgtttgtttctcctgccatgttaaatatattacaagcttgctagctttcactctgttattgatatcttcaatacatgaagaggaagtgcaagataaacagaaacatttatagtcaagggaaacacaaaggcattaaataaaattaaaagatctggaatggtgagtctgattagtcagggagcagacacctggtgtcttagacaaaacaaccattaaaaaaaaggaggatggaaaatggaatgactcacttttactatatatgtatctcatatgaagtattttcttctgggtaaactagaaaataaaatgcaactattttggagcaatattataatatggaagctgagagataattatccttcagatatctttttctgtcaggctaaataatgtgtttcttcatctttccctaaaatcaggtctcataaaccttcagagtttccatttcatgtataggttgagactaaatttagaaaaatcaggtcccataatgttctaaacagagatggacacacacacaaaaagaaaatgtaaccattgaacaaaattagattatatttagaaacagaattttttttttttgagacagagtctcactctgtcgcccaagctagagtgcagtggtgccatctcggctcactgcaacctccgccacccggattcaagcaattctcctgcctcagcctcccaagaagctgggattacaggtgcccgccaccacgcccggctaattttttgtattcttagtagagacaaggtttcaccatgttggccaggctgttgtcaaactcctcacctcaagtgatctgcccgcctcggcctcccaaagtgctgagattacaggcgtgagccactgcacctggtctaaaaatagaaattttatgtgtgtatatatatcaataaaagtatcacaattactgtccttaaaaagcctaggtttggaagaaaaattataatgggaaacatactgtgacagctcagtaaaagacaactaaggtagttaactgattctcctatttactatctgtcaaaagacattatttgtagtagctgaattgagctgattttcttcatacctcagaaatatttcacccatgggacattacataatattctctaggacttacgcagtgataaatacctgaccaaatttataataaagaaatctttcattcatacatttaaaaaaaatgaaacaaatcaaaatcatgcaggataaagcttaggtattttctgcctaagaattttactgaataaaatcttacaagactaggtttttcctatgtgctcaaatattgaaaatttatcttttgtctccagcatgtctttcaaactgaatttaattggtaaattatttaaactatgtgcataacacaatacttacttgaaaattgatctgagtgaatcatgagcatgtaacatttgagacagagaactacatgcgaattttaagtactaggaataaattgaaatacttcggatatgcccatttcctaagtatacttaggatatacccatttcctaagtatttcaatttattcttaatacttaaaattcacatggcactacgggcttttaaagtattttataaatataaatattttaaaaatattaaaatgttataaatattaagccttactgcatttctgctcccacctcaaatctgtgtatactgcattaagtcatattcctaggagagaaaggacccaccttctgtaacttaaaattaacactagaaatgtttccagtaaaggaaataaaaagaattatctgagtgaaagaattcagtaaagaaccccgtataaatagtactgccctccaaactgtgcattatattgtctatgaacaagaaatgaaatggacatggaccatcaaaagcgggaactgtgtagagcggtgcttttcaaacaaatcacttttttaaaacaaacacaatcactaaaaatgcagattctaactcagtaggtctgaaagtggggcttttctgcacttgtaacaagcttccaggtgatgctgatgcctcctgtccacggaccatactttgagtaggaaggcagtagaacacatacacctttttttttttccgccactctttcgcccaggctggagtgcagtggcacgatctcggctcactgcaagctccacctcttgggttcacaccattctcctgcctcagcctcccaagtagctgggactacaggcacctgccaccacgcccagctaattttttgtatttttagtagagacagggtttcaccgtgctagccaggatggtctcgatctcctgacctcgtgatccatccgcctcaaccttccaaagtactgagattacaggcatgagccaccgcgtctggcctaaaatacatacatgttatctggaggtgcgaaagcccagtgccagaagaccaccagttaggtttatcggcttgctacagtaaaaggagaatgcgtactctaggaaactgggcatttctgcaaaggggagttaaaatgaacttgctatagagattgtgttttctactgggtgatatgggagaaggtaaagaaaacagaagtctgttgtgaattcagtgttgtcaggaaccaaagattactggtagactaaacattttaataatttttatccagggagcaggaggaacaaagaggcgctaaagttgataaaaaagcaattgtcagccaggtgcagtggctcatgcctgtaatcccagcacttttgggaggctgtggcaggaagattgcttgaggccagatgttccagaccatcctggccaatagtgagatttcacctctgttatcttttaattgttaaaaaaaaaaaaaaattgtcagtcactcatgttactgaggagaccatataagaactgagactgacccaagaacaacaaactatgttttacctcttggtctctatagacaatatgacaatgagagaaagggtgggagaaattgaccacttattacatagtttacccctcccgccgtgtatgatgtgaatcctgttatacattataagattgttatacaatcctatgttatacaatgttatactttctgatataaaaaaaaaaaacctttttgtgcacagaatatgaaaaagggactacacaataagcgagagtcttcgaggtataggccagtacattaatatcctttggggaactacctatgttatatgactctcatgaaaaacgcacaagaaaagcagatagagaatacagcaagcagactgctttgcacacggtaaagggcagtgctcagaaatactattaagaaataatattaccatttagaagcttcctttaaatgaaaataactgtggataaatatcccttctaaccaccgcatgaggcaacgtacttagcatatggtatacggtatgagctttagacatggactgagaatcttggcttcacacttaatatttataatatttagaggacaacttagttaacttttctagcttcagacttcttatctataacatggaggcaacactgttaactttgttttaaggagtaaataaaatatgcaaaacatttaatgtattaagtacctcacagttggccctcaacggcatttaaagtgaacatggtaccaaaccagattcaaaatgccagtttaacatttattcatcccacagatatttgttaccatgtgccagacattgtgtttagaaagaaatgtaatattttaaaagtacctggcttcctggagtttacagtctagcataaggacaattaatctgacaatagaaagcacaggatattaccagaacacagagcagagagacctgaagcaaagcagcagtgtgaggcagggaagtctcctcggaggaagaaaacctgaaggaaaagtaagagttctgaaggacttctagttacagctatgtggagaagtcagtaatttgttactatataaaacaactataaaatttggaaaaaattatattaaaaataacatttcagagcactgaaaatagaccaaagcagagaacaaatgaaaaagcattcattcttgaaaatcacctcgaggttgaagtcagtttctggggacctccttgtagaaagcattcattctggaaaatcacctcgaggttgaagtcagtttctggggacatccttgtagaaagcattcattcttgaaaatcacctcgaggttgaagtcagtttctaggggacctccttgtagaaaacattcattcttgaaaatcacctcgaggttgaagtcagtttctaggggacctccttgtagaaagcattcattcttgaaaatcacctcgaggttgaagtcagtttctagaggacctccttgtagaaagcattcattcttgaaaatcacctcaaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctaggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctaggggacctccttgtagaaagcattcattcttgaaaatcacctcgaggttgaagtcagtttctaggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctaggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctagaggacctccttgtagaaagcattcattcttgaaaatcacctcgaggttgaagtcagtttctagaggacctccttgtagaaagcattcattcttgaaaatcacctcaaggttgaagtcagtttctggggacctccttgtagaaagcattcattcttgaaaatcacctcgaggttgaagtcagtttctagaggacctccttgtagaaagcattcattcttgaaaatcacctcgaggttgaagtcagtttctggggacctccttgtagaaagcattcattcttgaaaatcacctcgaggttgaagtcagtttctagaggacctccttgcctcaggctgcttctaccctacactcagctgccgtggtgaaaactttgacaaacttggggctgtctgcaaaagccagtatctttgctaccagaaggggcagatctgctgcgggatggggggcaaaactccaggtctttatcagctaaagtagcaaatgtggtgggagacaaaaagggaaaaaccttacctttgttccctaacgctatagtccaagttggggcaagtggtaggaggatcccttgagcccaggagttcacggctacagtgagctatgatcatgccactgcactccagcctgggtgacagagcaagattctgtctccaaaaaaaaaaaaaaaaaaaaaaaaaaaagcaaactccataagaaggaatactggaaattgttgatatgtaggtaaatataaaagcctgtatattatatactgtatttttaatttctttacaaatcctaagattggcttaaggtaaaaaccattattcagtggataacatatatagatggacagtacatgacaaaaatagcacaatgcagaatggggagggatgaagctgtatgggaacaaagttaccatacttcactagattaagtaactataaaactttcagattatgctatgttcaagattcatcctgtaatccttaaagcaatgctatccaacagaaatatgagaaccataaatataagtcacatatataatttttaattttctagtaatattttaaaggtttttaaaacatgaaactttaacaacatattttatttaatccaacatatccaaagtattatgacaacatataatcaatacaaaaattatgaatattttacattccctattaagtcattgaaatctgatttgtatttcactttagcacacataaattcagactagccacatttcaagtgcacaacagccacatgtagctagtggctactgcagtgggcagtacagcactagagcaacaacaacaacaacaacagatgacttttaaaaaaatcaacagatgaattaaaacggtacactccaaaaatatttaacgcaaatgtaatagaagaacagaggaagacaaaaaagacatcaaacctatagaaaacaaaaatcaaaatggcagacataaatccaaccatatccaaaattacattaagcatgaatgtaccaaacattcacatcaaaaggaagagaccatcaggctggagttttaaaagcaagcttcagctgggtgcgatggctcatgtctataatttcaacactttgggaggtcaaagtgagaggatcactcgaggccaggagttcaagatcagcctgggcaactaagcgagactctatatctgaaaaaaaaaaaaaaaaggcacagtggcatgcacctatattcctagatacatgggaggcttaagtaggagaactgcttgagcccaggagataaaggctacggtgagctttgattccaccactgcactccagcctgagaaacaaagcgagaccttattgagagagagagagagaaagagagagagagaaagagagagaaaaagagagagagagagagagagaaggagagagggaaaaaggagagggggagagagggagagaaggagagaggaggggaaaggaaaagagaaccaaaaatgcaagactcgaccatattctgtctataggagatatatactagattcaaagatacaaacaagttcaaaagaaaacaaaccagtaatcataagaatgctgcagtgactatattaatatcaaacaaaatacactttaagacacacatattactagagacaaggaggaacatttgataatgaaaagtaacacatttcataatgaaaagctaaatatgtaaaaaggagagagggaagaattttctgagcattaaagatccagaagcaagagaggtgctttcctatttggtactcccgtctccagctgttcatatcacattcccaactcctatcagcacaacccatggcagcatcctataaatctcatcttaccccgaacattcaatgtcttcaaattcctatgcctttgaacatacccttgcactatccataacactgacctcaatatttgcatcagaaactcccactcatccctccagtttcagcttatcaccaaacccttctctgaatacttcaccgaagcttgcaaatacctacaataaagctctcattgctctccaactatcatttgaatttccctccagactttcatcctttttttttccagtttgcagcatcaggttctatcacaaaacatgacacataataggcattcggtaaatgcttgctaaatgaaggataaacgaacaaatgaacaattgaacacatgtaggaaggaccaaggttggtgaaaatgggagttgaagatttttttcacaactcatatcagaggaattaaaatagaatgaccaggaaacatgaaacgcatgaaagaattactttaggcaataataacaataataaccaacatgagaggagcactcactatgtgtcaggtactgtgctaagtatttcacatatatcaattatttcaatcctcataataactccattatgaaggactacttttgagggggtttttagacacaagatctcactgtcttgcccaggctggagtgcagtgtggctcactgcagtctcaatctcctgtgctcaagcgatcctcccaggttcacctcccgaatagctgggactacaagaacacaccaccacatccagctaattattaaattttttgtagagatgtggtctcactctgttgcccaggctggccttgaactccaggcctcaagtcatcctcccacctccaccttcaaaagtgctgggattataggtgtgagcccaccatgcctggccttgaaggtactagtttttagagatggttcaacagcaaaaaaaaaagaaaaagaaaaagaaaaaaaaaaaactcaattagaataaagaaacatttcactaaaagaagatacacaaatagtcaataagcatatagaaacatgttcaacatcatcaatcattatggaaatagaaatcaaaaccacaaagacaggcgacttcaaacacactagaaggctgtagtttaaaaaacagagaatacaggtgttgacaaaaatgagaagaaagatccctcatacttactggtgggaaagtaaaatggtttatcacttaggaaacaacctggtagtcccacaaatcgttaaatactgagtaattatacaatccatataatgagtacaagttttattttagaaagaaggaaaatgttctaaaataggtaatggctaaacaactctgagactatgttaaaaaaaatacacagaactatacaatttaaatgagtgaagtatatgagatgtgaattatatctcaatgaagttctttttttaaaaaactaacttaaaaaatgtttaagcttgaccattataatccagttactcagtgacagaaccagaggctgcctgatcccgtgttcaggattcctacatacatcacaaaatcactaagagaagcatcacaattagctcattttcaaaaaggacttcatctatttctctcaaccaaagcaatacattctaacataagcactttgtgtactgatgtaatatttctcaaaaagttaaacagcatgagaaatttataatattagataaaattacaggctaggcatagaattgcctagtggctcatacctataatcttggcactttgggaggccaaagtaggaggactgtttgaacccaggagtttgggaccagcctgagcaacatagcgtgacccccatctctaaaaaaaaaaaaaaaaaaaaaaaaaaatttaattagccaggcatgctggcaggcacctgttatcccagctacttgggaggctgaggtaggaggactgcttgaccctgggaagtgaggctgccgtgtgccaagatcgcgccactgcactccggcctgtgcaagagagcaagaccctgtctttataaaaaaatctaaaaacaattgtcttatttctaactctgaactactttctatgctttggtgacatctatggtgaaaattgaaaactagcattaacagctagaaagaagcaaaggatttttccacatgaattccatctttcttagctttgcttttatttcacagaaacagaaaataaagaaaacctaatcagttaaattactcctctctggtgtcacatcctaataaataactgttatccttatgtccttcaagaaagaaatgatactagtaggacaatcatgtatgttttctgattactcttatcaataagtacctaaaatattaggcaaactaactcatatatagcacagctatgtagtatgtataactgacaaaacccaagatctctaacacattggaatgtaagtattcatttcctttaagaatagaatccaaacagctgtttctcaccaatatacactgtgagagaactcctgtgtacctccttgccataacgaaaggaagtttaaccccacagtacacaaacctcactgcacacacaagatcctgatgtcagaacaccaatactgaggggcgtacaatgtaaacatacagcaggaacctatggcagaggccgaaccttaatcatttccaccaacctttggaattctgctttggatttcactggaacacaggcttttgacagagaaatcagaatattcgaaaacaagaaatcaccaatatcaggctcttaagtcctattgttgtaaagactgaacaatgaacatagcagcaatcaactcccaaacttagctatgctttattatatgagagcctcccgaactcagctatgctttatgatataagagaggctcccgaacctagctatgccttattatgtgagaggctcccaaacttagctaagctttatgatatttgagaggctcctgaattcagctatgctttatgagataagagagcctcccgaactcagctactctttattatatgagaggctcctgaactcagctatgctttcttatataagacagacccccaaacgtagctatgctttatgatatgagaggctcccgaacttagctacactttattatatgaaaggctcccgaactcagctatactttatgatatgaggctcccaaacttagctatgctttatgatataagagaggctcctgaactcagctacactttatgatataagagaggctcctgaacctagctatgctttatgatataagagaggcaattcggtcacttgttgggtagaacctcctgggacaagcagtcaacagcaagaaagcaattcctgctccctccattttaaaacagaaggctctatttttaccactatccccaagcaaccaaaccagaaccaaatagcatggatcttttggaacgaggaaagctctaaatgccaaagtccaagtgtagaaatatatcttaacattttgctccatccttcaaatgtttcaatgaaatgtttcaatgctgtctgaatagcaacctcaataccaacatctctcatgcagtccaagtggaaatgttccgtttcttctattttccttcagcctgagacaaattgattcttttcaaagagtcatttcaatcatcctcacgggttctcttaaaatagacaaggcaaaaccactggctgttacgtgcctctcacaagttccacctttttcacaagtggacaatgtgcactactactgcgagtggacccccacggtcagacagggaagaggaacccaccatggctggacagggaagacgaacacaccacagtcagacagggaagacgaacccaccacagtcagacagggaagacgaacccaccatggctggacagggaagacgaacacaccagtcagacagggaagacgaacccaccacagtcagacagggaagaggaacccaccatggtcagacagggaagaggaacccaccacggctggacagggaagacgaacccaccactgtcaggggagaggagcccgatcgctgcctctatgctctgccaccacctagtgaataagaacaagaaaatcacatggcaagagcctgcagacgtcaagacacctatgatagacacctaagatgatagggtggcttttaaaacctgattttaagattacaaggttagctaaatatctgaggtagtttaccaggaaaaagaaaaatgtttagaggaagaacttggtcaagagcctttatgagagtgagggtcactatatctcatcatgtaaggggccttaggaacacaccccaaattatcggacagtctagaaaaatactatttactttaggatggaagtatgagttgctcatatataaatgacagaaataaattagcttttgcaaattgggctttataggtatacgtacatcaatatcctactggtacatgtctccatttttcttgatcctatactgtttggaaattttagtgttagcttctcagctagctgattattcattatcaaagcttttttgttcccaacggctcacttactaattatatatcaaaccacaaagctctcgaagtttctgctccctccttagcatcctatctggaccatcagacagcttctggatcagaactggatatacatcatcaacgcacactggactaattcaggataactttcctaagaccaaagaacaaactattatgcaacatcggtttattttgatacttaagataaccagtgctttcatatactcaatgatatggtttggctctgtgtccacacccaaatttcaagctgaattataatccccagtgttgaaggagggcctggtggggcacgactgaatcatggggcacattcccccttgctgttcttgtgacagtacgttctcacgagacctggttgttctcctgccagccatggtgagatgtgcttgcttccgctttgtctttcactatgattgtatgtttcccaaggaagcagaagactgtatggcctacagaatcattagctgatgaaagctcttttctttataaattacccagtctcccatgtgtctttatagcagtgtgagaactaatacactcaacaagtacaaaaactacggcttaaccacagcaacaatatttatttaccaagcatggctgaagatactaaaggagtgtgtcactgtgatgtagaatttctagagattaggaatccttaggatgggtatgctcttcggaaaactgtaccatctctttgcctgttcatggaccactgtcagtctgttgcctgttagaaacctggctgcacgacaggaggtgagtagcgggcaagcaggcattaccacctgagctccacctcctgtcagatcagcggcagcattagattctcatagtagcataaaccctgctatgaactgtgtgtgcgagggatctaggctgcacactccttatgagaatctaataataaatgtaatgtgcttgaatcatcccaaagccatcccctgtcctccagtctgtggaaaaatgatcttccaagaaaccagtccctggtgccaaaaaggttgggactgctggtacatcatatattagctctgtgaccttcttaactatttcagatgataccttttgtgctctcggttgaaaaaccatctccgaagataggagctattttaacacagctatcctaaattccttacttatccatcatggaaaaaaacaaatgtttattattgccaggccctcaagaagtgaatggtctagtaggaaaaatatacctagacagatgtagtcacctgatgggttcttcttgcctgctgcacagatagagctgattcagagacaacagtataaatgacagcagtggagaaagaggttacaaacacagagccagccaagcaaaagaacaggagtttattactcaaatcagcctccccacaagctcggggaccagggcttttcaaggataattcagcaggcagggggacagggaatggggaatgctgactggtttgggatgaaatcataggggtgtagaaaacaggccttgtgtgttgagtcggcctctggggtgggggcacaagactggttgagtcataaaaaaaaaaaaagcaagaaaagaaaagaggagaggggaggggaggggagaaagaacaacaacaacaacaacaagactggttgagtcctgggtcgtgggtctgggtggaatccgtcaatcactagaatgctaaagtctgaaaaacatctcaaaagaccaatcttaggctctacaatagagacgtcatctgtaggagcaattggagaagttacaaatcttgtgatctccggaacaatggctggttatggtctaactatccctacatctcagcagaatttcaggctcttcccatcatcctaatctcatcggctttcattaattttacaaaggcagcttcagtccctgagcaagaagggagttaatttgagggagggactgttttcatccttgctccaaggttaaacgacacactcaattcttcccgtggttagtttggcccacgcccagaaatgggcaaggacagcccgcctgtgagcttagaaggcggagtcagccatgctggacttctctgtcataatcattgcaaagctggtttcatagatgagaatctataataaggtatggtaaaagctaccatagagagatgtacaacatgcagtggtgatgacctctacttgggaatagcttcacaaatgaaatacttagagtggttcttaaagggcaagggttaaaccaggctgacaaggaaaagcatgtacaatggtaaacagtacattcaggggactgtaaatagtatagagtgactgaagcacagagcacaaagagggagacactggggctcaggttagtcagatcagcaggagccaaaaggaggaggagactggaagagaaaaactgagaatgaggtatgcacaatggaggaagataaacaggtgagagcattcacagaacccaaagaaacagaattcaagaactagtgatgagtctgacaagagctatataaaatagacagtatcaaacaacatccaacacccagccctctttctactattaataaaaagactgattgcccagcgtaattagtcataccataaaggagtagatagttgtagattttctcttgagatttcaactgtacacaaatttttcatatattttatttttattttatcttatttatttgttttgagacagagtcttgctctgtctcccaggctgcagtgcagtggcatgatcctggctcactgcaacctccgcctcccaggttcaagcgattctcctgcctcagcctcacaagtagctgggactacaggcatgtgccaccacgcccagctagtttttttgtatttttagtagagacagggtttcaccatgttggccaggctggtcttgaactcatggcctcaaatgatccacctgcctcggcctcccaaagtgctgggattacaggtgtgagccaccttgcccagccccatattttatttttatttatttatttttgaggcacaacctcattctgtcacctgggctggagtgcagtggcatgatcactgctcactgcagactccacctcccaggttcaagcaattctcccgcctcagcctcccaagtagctgggactacagatgtgtgccaccatacctggctaatttttgtattttttttacttctttgtacttttgggtttttccacattgcccaagccggtctcgaactcctgggctcaactgatctgcccgggtcagctttccaatagtgctgggactacaggcgtgagctaccatgcccagcctctcatttttaatagatactattttaaaaagtactgtgaaaaagaaacaaaaatgaaaaagacacatgcctatccttaaggaacttatgtcctaccaaactataaagtaagccataccatttatggatttgtagcaacatgtcatcctgtcaactttattactgaggctatgagatgtattaacattggctttcaaattatttgtattagcaaacataaaattcaagcatagaaattgagtctgatctaaaaatcagcaaattacaattatgaatttgttatattctcactgtatccacgtcctcaaaactctgacattagcaagccattaaacaagaccactaagattacattaattttatactaaagttgtatgctaaaattttcatctttctctgtttcatctttctctgttttcccaaaagaaaaaaaaaggtaaagatcaaaagttatatatttcagatatataatcctaaaaaatgctccattgctaggtgactaattttaagacactgccatcagtttaacaggtcactcgttcatttattcatctaacatttatttacccacatactgtgataggcagtgaggaataagcacagaacagaaacagtgcctgccttcacaaagcttagtctagcaggatagtaacttaagacactgaaacagtatattaagtgccttttacaaatattcttcgcagctataccagctactacttgcatttcaacattttatttcaaagccattatttatttgtttgtttattttttttgaaatggtgtcttgttaggttgcccaggctggtctcaaactcctgggctcaagcagtcctcccgcccgagcctcccaagtaactgggattaccggcacatgccactgtgtctggatccaaaaccatttttttaaaattatttcagtgttaagacaactttaagaaacaatattatgattggtatcggtcattaattgtgctattttatgacttcaatcttttgatgcagtatagtttcctggccatttccaatagaaaattccttgcccctttcaggctactgtagttgagatacaagacttgagatatttttctaagagaaaacaaaacaaacaaagcagccaagagaaacaatatcagccatgtaataaaatacccaatgtactttatttcattatcctaggcaaataaaaaaaaaaccactatgaattatacagtatacaaatatgttttcttcggaaaacactgaaaaacagattcatgtggaaagaaattactttattcctaccactgtctttttcagacacactcaaaattcataaaattcacaaaatctgaagctcataaatcaaaagaaactgttcatacatcatgaacactatactaactttttaaaaagtattcgaggcagctgaacatcatcacagtatcttaagactcatatttccttagattaattcagtgatcactttcaaagcaaagctttttatgaaagctaaaataaaatttctaggtaaccaaggagagtctttcaaatggaaaaaagctgatgatattaaactctaaaaaataaggcccaggcatggtggctcacacctctaaatctcagcactttgggaggccaaggcaggagtatctcttgagcccatgagttcaagaccagcctgggcaacacagcaagaccccatctctatttaaacttttttttttttgagacacagtcttgctctgtggcccaggctggagtgcagtggtgcaatctcggctcactgcaaactctgcccctcagatttaagatatcctcctgcctcagcctaccaagtagctggattacaagcatgtgccaccacacctggctaatttttgtatttttagtagagatagggtttcaccatgttggcgaggctagtcttgaactcctgacctcaggtgatctgcccacctcagcctcccaaagtgctaggatacaggcatgagccaccatgcccagccttaaatttttaaaaataaaaaatagagtatgtaataatcatataaagttctaaaacatccagtagcaatgttcttaaatcccagtaattcaggtgcttttttttttttttgagccagtttcactcttgttgcccagactggagtgcaatggcacgatcttggctcaccacaacctccacctcccaggtccaagcgattcacctgcctcagcctcccgagtagctgggattacaggcatgtgccaccacgcccggctaattttgtatttttagtagagatggggtttctccatgttggtcaggctggtctcgaactcccgacctcaggtgatccgcccatcccagcctcccaaagtgctgggattacaggcgtgggccgccgtgcctggcctcaaatactattttaagattgttcatccataatacattgtagtctgaaagaagaataacctctctaaacagtacctattaccttcatcctctctttttccaatataatggcaaaagacagagttgtgatatttttactgtaatcacagaaacatcaattcaacatatataggattagcatatcacacatttcagcaaatatcaaaatacagatgtttcttcatcctgatgaacaaatttattattaaacttgccaactattttccaaatttataaaagaccataataaaatgtgaggcaaaactgttcaaaccagttaaaatgagtctcgatcagctaaaatgattaacaacgccatcttaaagatgatcccatatctgagcacgtgatacctctgtgatttcagggcacaaatccctctatccatcaaactaaatagaagggttagagaggttaatcgagacagagtgtctgtaacagacttctgcatttcattctccactcaatatacttcaaacatcattgaactatttgttatgttcttatgaatcaatgctcccttcacagtcaagatagaggctagaagccactgtgtgaagtaataaagcttacctttgcaaatcctcatcaagctgatctgatgattaagtctatgtgaggcttcctaaacaactgaagtgtaatcacaactttaattagaagctcaaatggcactgctaaacacctaaataaaacatgagcaagtacaatagccacctgcaacgagcaatgccattttccagcctccatttactataaagagatttttctctattcagctgcacaatcacttgggctacatgatctctggcctagcaatagcagtcaataatttaaaatcatgaaaataaattttcaatctatacttaagttctattatgcactggtggtagtcaaaaatgtcacagactgaataaaaatgaagctcactcatttgctaggctggcaccccattctacccgaactgtccattaagagtcaccattaaaaacaaacaaaactcatatggcaaacttctgataaaccaatttactctatttgtggctgattaagggtgatcctggactacatggcttttttagttcctccctgactaatggaaaattactagaagagtaaggactacacagaactagttgcataaattacagttggccaggtgcagtggttcagcctgttatcccagaaatttgggaggccttggtaggaggactgctttaggccaggagtttgagaccagcctgggcaacatagtaaggccctgtgtcttaaaaaaaaaaaaaatttaattagccagaaatgatggcacatgcctgtagccccaagtactcgggaagttgaggcaagaggattgcttgagcccaggagttaaatcagatggcattagtgatggttgcacataccaagaaaaatatatcccagtttccttctttactccctgttttaaacatatatcctatcttcctagttcatctcctctggtctctccttctatgagatatggataatttattccctatccttgctgccttctaacagtagtataagagaaggtataatcagtggtaagaacatttaactaggaaataacccagaggtccactgacagaaaaactgataaagtgtggtctatgctataccacagaatatcacaaagtggtgaaaattaataactaatgctatgtgcaataacacatacatgctgaaaatgtaatgctgagcatttttaaatttcataagactatattcagcaatgataccatttatagggctcaaaaaacaagaaatatatatccgtgttcaagcacacatacatttgtgacaagcatagaaaacatatacaaagcatgtgaaacgtctcagataccctgattcaaagtcaagggtctcatggaaatttattcaggtttggatgcacacctgacttggcatgtatgctgctctacataggacacacccaacacaaccaacctagtgttgctctaaggccgctaacctttaaaataaataaagccagccagcatatcacccttcattgacctatcttaaattcgaatcacaatgatagctgtaagtggaaattttttgcttttcgttataaaagctttacacataccctggtggccaccgctgctgaggtcagcagcaccacggcagctgtgaaaggttagcagttttgtttttgtgtgttgaggccttggctcaagatcccatctgtgctgacttcagactgaagggaacacatttcctccagcctgaaaactgaaacatatgccgcaataattagagcttccttgagtcagttcagctgaacccaggatgctgagactgataacctgtgagcacactagaagacttcacatacggcacccacctgctagacaaagacagacatgaagacatggccacgaggcctccatatccaaaaagacagaagtcccatcatctatatgtattatgtctatatctgcttgcagactcctgcttctgctaaaaagtacagtgaggagtttgcaagttaaagagacagaactaagtcaacaaaactgcagcatttagaaagcccctgcaagcacttgatctctgcgtcctctttacttgatctctgtgccctctttacgtgatctagacttgtgctctccaatactggccacatttggctagttaatgaaaattcaataaaattgaaaatcaacttcctcggtcacattagccacatttcaagtgatcaataaccacatgtgactactggctgattaccatattggacagagcaagtataaaacctttctttcattacagaaagtgctttgggcagtcctgacttagacactaatccacttttttactcttattatattgactcataataattgtaaacatttatgaggtacagcatgattctttttttagacgggatcttactttgtcactcaggctgaagtgcaatagtgcaatcacggctcactacaacctcaacctcccagactcaagtcatcctcccacctcagcctcccaagtagctgggactacaggtgtgcacgaccacacctggctaatttttatattttttgcagagatggggtttcaacatgttgcccaggctggtctcaaactcctggactcaagtgatctgctcatttcagcctcccaaagttctgggattacagggatgagccaccatgcctggccatacagtatgatatttttacacgtatacacaatgtgtaatgatcaaatcagagtaaagtagcatatccaccacctcaaacatttatcatttatttgtgttggtaacactcaaaatctgcctttctagctactggaaaatatacaatacgttgtggttaatagacactaatccacttttaaaacaaaaccaaaaccgccaccagcatgctgaacatcaaaatcccagagctagccagaaaatgtcaaggattagtcacccagcacaattaatctgagatggtccacaggcttccagggttgaggcttctcttaagtggtgtctttattttatttcattgtttactgtcgcacagcgattaaaagaatggactctgaggccaggtgcagtggttcacgtctgtaatcccagcactttgggaggccgaggcgggcggatcacgaggtcaggagatcgagaccatcctggctaatacgatgaaaccccgtctctactaaaaatacaaaaaaaattagccgggcgtggtggcgggcgcctgtagtcccagctacccgggaggctgaggcaggagaatggcgtgaacccaggaggcagagcttgcagtgagcccagatggcgccactgcactccagcctgggcgacagagcaagactctgtctcaaaaaaaaaaaaaaaagaaagaaagaaagaaaaaagaatggactctagaattagacggtttgagcctgaatcgctgcaacagtctgttaattattcaaactctctcattctcctgtaggttaaatcgctgcaacagtctgttaattattcaaactctctcattctcctgtaggttaaaatgggattttttttttttaaatagagacagcgttttgccatgttgcccaggagcttgaactcccaggctcaagcaatctgcctgcctcagcttcccaaagcgctgggactacaggtgtgagccaccgcgcccagccaaaatggggatactaatagtatctacctcatagatttgtttaaaaattaaatgacacaatgtttgtaaatctattagtaccatgcttggcatagagtaagagctctataattgttagctattaactattattatccttgccaaaaggaaggagaagaaaagcatgaggctgaatttttgaattttgcccattaaaaaatatcggagctctggtaaagatgcactatgagagaaaatcaacacatatgatctgtttcatcttcagccttgtagtttaataatttcctttctcacctttaaaaagcttgtccttgccttttcgctcttcttgtaagtctctcttcagtgcaccgtgtccatagtgctacgtgttaggcactattcaaagcacatgacatgtaccagcttaataaattctcacaacaatcctacaaggtagatactcaatgtgcctatttattttcaagtgaaaaaacggagacacttagaggttaggtaactagtgcaggatcacatagctagtaagtgacagtgtcactggctccaaaagcaggcagtatggatgaagaatctctgctccatcacagccatcgtgcaaaattgcttcgatatgcagcagtcctcccttcaaaacaaacaaacaacacctttcccaagctatcgacctggtaatattattatagtttatttaattagattggcaggacaggcaaggagaagtctcttgggatttggatatgacagcagctctcattgtcctgtcttctgactaaatcccctgggggatgtggatggaataaaactctgctattcagaagggttggcattgccccctgggaggtctggaaatttatgaggatagtttggttttcacaataattggggggtaccatcactctgaaggagacaaaggtgcttatatcccacattatctgtcacaatcacatacaattttcaaatgtccactttagacaatttaggtctagattgtaactgctgattatgtataaggagcaattctcatattgttctagtgtatttaatatagttctaagattgcaaccaccaggtaaaatgaaagaaactggtacttttgtcttcaaaaccttagcaggagttgttcatcatctgagactataaggtcatgctatttgaatcccaaagacaacacagctgtatcagtctccaattagagccgcacattcacagtaaggctgcgccatgaccgctctcctagtgccaaaacatttatataaaacaatgtcctaggcagctgaggctgctataacagaataccacacattgggtggcttatatgcaacaaaaatctatttttcggccagacatggtggctcgtgcccgtaatcccagcactttgggaagcagaggcgggtggatcacctgaggtcaggagttcaagaccagcctggccaacatggtgaaacctcgtctctactacaaatacaaaaattagccaggagtggtggcaagcgcctgtaatcccagctactcaggaggctgaggcaggaaaatcacttgaacctgggaggcagaggttgcagtgagccgagatcacgccactgcactccagcctgggcaacagcaagactccgtctcaaaataaataaataaataaataaataaattatatatatatattcactcttgaggaggctgggaaatccaaaaatcaaaacgtctgcatattcagcgtctgagagctcactgctcattcagtgtaaatgaagaaacctgagggcaggtttcttcatttacagatggtgttgctgtgtgtcctcacttggcagaaggggaagtcagctcccttgggcctcttttatgagggcgctaatcccattcatgaggactctgccttcctgagctaattacctccccgaagcaccacctcttaatattatcaccttaggggttaagatcacacagcatataaattttggaaggacacaaacactctgaccacaacaggtaatagacaccatttgataaataattttccatttatttcttctttatattttcattgggtcattatattgctattttgaaactgtctatataaatagttatatattatctaagactctcccttcaggatagcatttgtgtgtgtgtgcgtgcatgtgcatgtgtgtttcaaaatacatgtttataaaaaggggttttgtgcttaataggggtgatgtcctctgctcggcatctctgggaaagaactggtctacagaataagctgttgctgtttcctatcaatattttactatacaggaaaatcagagctacatgtccttaacaccagctttctggtgagggaattactgataagtaatgagaattactgataaacagagagaaaaatgaaatttatgagttctccatcaagttctggcctctccccatcctaatccctatctcagaagcaagtcttttttttttttttttttttttttgagatggagtctagctctctcacccaggctggaatgtagtggtgctatctcagttcactgcaaactctgcctcccaggttcatgcaattctcctgtctcagcctcctgagtagctggaattacaggtgcctgccaccacacctggctaatttttgtatttttagtagagacagggtttcaccatgttggccaggttggtctcaaactcctgacctcaaatgatctgcccgcttcggtctcccaaagtgttgggattacaggcgtgagccaccgcacccagccaagtctttaaagtataaaaccttaaggttcatatccttcacccactttttgatgggtttttttttcttgtaaatttgtttgagttcattgtagattctggatattagccctttgtcagatgagtaggttgcaaaaattttctcccattctgtaggttgcctgttcattctgatggtggtttcttttgctatgcagaagctctttagttcaattagatcccatttgtcaattttggcttttgttgccattgtttttggtgttttagacatgaagtcttgcccatgcctatgtcctgaatggtattgcctaggttttcttctagggtttttatggttttaggtctgacatgtaagtctttaatccatcttgaattaatttttgtataaggtgtaaggaagggatccagtttcagctttctacatatggctagccagttttcccagcaccatttattaaatagggaatcctttccccatttcttctttttgtgaggtttgtcaaagatgagatagttgtagatatgcagcattatttctgagggctctgttctgttccattggtctatctctctgttttggtaccagtaccatgctgttttggttactgtagccttgtagtatagtttgaagtcaggtagcctgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatagcttttttcatgatattgattcttcctacccatgagcatggaatgttcttccatttctttgtatcctcttttatttcattgagcagtggtttatagttctccttgaagaggtccttcacgtcccttgtaagttggattcctaggtattttattctctttgaagcaattgtgaatgggagttcactcatgatttggctctctgtttgtctgttattggtatatatgcttgtgatttttgcatgttgattttgtatcctgagactgctgaagttgcttatcagcttaaggagattttgggctgagatgatcgggttttctagatatacaatcatgtcatctgcaaacagggacaatttgacttcctcttttcctaattgaatgccctttattcccttctcctgcctgactgccctggccagaatttccaacactatattgaataggagtggtgagagagggcatccctctcttttgcccattttcaaaaggaatgcttccagtttttgtccattcagtatgatattggctgtgggtttgtcatagatagctcttattgttttgagatacgtcccatcaatacctaatttattgagagtttttagcatgaagtgttgctgaattttgtcaaaggccttttctgcatctattgagataatcatgtggtttttgtctttggttctgtttatatgctggactacatttattgattttcgtatgttgaaccagccttgcatcccagggatgaagcccacttgatcatggtagataagctttttgatgtattgctggattcagtttgccagtattttattgaggatttttgcatcgatgttcatcaaggatattgggtaaaattctctttttttgttgtgtctctgccaggctttggtatcacgatgatgatggcctcataaaatgagttagggaggattccctctttttctattgattggaatagtttcagaaggaatggtaccagctcctccttgtacctctggtagaattcggctgtgaatccatctggtcctggactttttttggttggtaagctattaattattgcctcaatttcagagcctgttattggtctattcagagattcaacttcttcctggtttagtcttgggagagtgtatgtgtcgagcaatttatccatttcttctagattttctagtttatctgcgtagaggtgtttatagtattctctgatggtagtttgtatttctgtgggatcggtggtgatatcccctttattttttattgcatctatttgattcttctctcttttcttctttattagtcttgctagcagtctatcaattttgttgatcttttcaaaaaaccagctcctggattcattgattttttgaagggttttttgtgtctccatttccttcagttctgctcttctcaaaagaagacatttatgcacccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaagtaggaacacttgtacactgttggtgggactgtaaactagttcaaccattgtggaagtcagtgtggcgattcctcagggatctagaactagaaataccatttgacccagccatcccattactgggtatatacccaaaggattataaatcatgctgctataaagacacacgcacacatatgtttattgtggcactattcacaatagcaaagacttggaacgaagccaaatgtccaacaatgatagactggattaagaaaatgtggcacatatacaccatggaatactatgcagccataaaaaaggatgagttcatgccctttgtagggacatggatgaagctggaaaccatcattctcagcaatctatcccaaggacaaaaaaccaaacaccgcatgttctcgctcataggtgggaattgaacaatgagaacgcatggacacaggaaggggaacatcacacaccagggactgttgtggggttgggggaggggggagggatagcattaggatatatacctaatgctaaatgacgagttaatgggtgcagcacactaacatggcacatgtatacatatgtaacaaacctgcacgttgtgcacacgtaccctaaaacttaaagtataataaaaaaaaaaaaaaaaaacttaaggtacagcagccactatcctgtctcttccccttgtcacctctccctggctgagccaacttgctttgcgttaactacctttctcacacatccccaagagcctacagaaaaggtctatgatcttggcttgttactaccaaatcatctcaaacctctcagcatctttacctactcagttaagtaaggaaactcacaattccttgagtagttcctgtagccctctcccagcctgaatggctcttcctggtgttgccgatgctaatcaatgactgaacacaggactgctgtctctctcatttctctgaactagctggcatatctttactttcttccctcttggcttctaatgaagacaaaactgcattgcctaattatcctttagaaagaaaaccttaacattctttaatacttgatctcttttcaatgccttctatttgtttctgtaattcagctaaaaatagttcagccattgaaaaaaatagattccaataaaacatattgaatgacaactatttaatgtgttaaaaagaatactacctgatttttttttttcagtaaactaaaaagcttcctgaatttgcagcattcttaaattgaagtaagaagtggagagacactttgggcagccgaggcaggcggatcatgaggtcaggagttcaagaccagcctggccaacattgtgaaactccatctctactaaaagtacaaaaaattagctgggtgtggtggccggtgcctgtaatcccagctacttgggaggctgatgcaggagaatggcttgaactcgggaggcggaggttgctgtgagccgagatcgcaccattgcactccagcctcagcaacaagagtgagactccgtctcaaaaaaaaaaaaaaaaagaagtgggaagaaagggagaagagattaatatagtagcagtttttaaatgttggtatgtaccagatcttcctaattacctgataaggaaggttacccataatttataggttgaagaaatcaaggcagagaggttaaacagtttgctcaaggtcatgtatagacacctccaccctcaccctcaaccagtgctaggattacaacccaatttgtctaattctattacatcatgctaccactctacagtaattataattagtgctaacttcataccaagaactgtgctaagtatctcatttagtctttataataaccctatgacgtaggtaccaaatttagcttcattttacaaatgagaaaattgggcacagaaagaaagtcaggttgcccaaagtcacacagtaaatagtccagcttatattcaaatccaggaacctgactccagaacctatgcccttaatcattaggcggcactctcggatagaattaaaatccaccaggcaaaaaatgagtaaatagctaatttttatcagtaaagattactgaggaaatcacaacagcgctattcccaacagaatgatttaacaatagctatgttcatgaggatgcatgatatagtttgaatatacgtccccaccaaatctcacgctgaattgtaatccccagggttggaggtggggcctgcagggaggtgtctgggtcatgggggaggatctctcgtggcccagtgctgtgctcatgataagatacgctcatttcaaagtgtatgatgccccacccccacacactagctcctgcttcctccatgtgacgggccagctccgctttgccttctaccatgattgtaagctcccagaggcctcatcagaaaccaagcagatgccaggtgccacacatgcttcctacacaggctgcagaagtgtgagccaaggaaacctcttatctttataaattgcccagcctcaggtacttctttatagcaacacaacagcagcctaatacaatgcactagcaaatcaaagtgggatttttgtttagtccacaagtgattaaaactccgaaaaaacaaaaccattaaccttacgaattaaatatcttcttttgatgggctaatgtaatattgaatatgaagtgattagaaagtaattccccaaaatttctgtctgtgggtggaaagaggggtggtatataacagcacaacacagaaatgtatccctacatgtgcctggttgaaaattcattttctctttggaatccaggctcctcctacccctagagcagtcagagagacatagctaccaaatgcaaaacagaatgcagtctttagagagagaccaccagggctgagatatcacccactgttatttacaaataaagccagcagtgagagatgggacagacatattagaggaaatcaaaagagtcatttttaaatgttaaagatttttcttggaaaatatgaaaggaaaaactaagaacattatcttggtaagttagcaaagccctgaagcaagcattggacatcccaaatcagccacatgggacacagaggagggtccacatagaaccaaagcctgtctcttctctacaaggttaaggtttgagtttcctagaggaagaaacaagagatttagaatgcatggtgtcatgtaaatcactctcactgtcattatttttaaggcttttacgtatatattttaactgcatactatatgtgtaaaatatatatattcatatacacataaatgcacacacacacacaaatacatatgtaaaaataaatgtacagctgattcaggtaaatcataccaggaaactgaagccagttttggtttttttgctggttttttttttttttttttgagatagagtcttgctctgtcgcccagaccagagtgcagtggcatgctatcggctcacagcaacctctgcctcctgagttcaagtgattctcctgcctcagcctctgagtagctggaattacaggcacacaccaccaggcccagctaatttttgtatttttagtagagacgacgtttcaccatgttggccaggccagtctcgaactcctgacctcaggtgatccacctgcctcggcctcccaaagtcctgggattacaggtgtgagccaccgcgcccggctggagccaggtttttgacatccacattgggtaaatcctggtgagcagaacagcacccatcacaaaatactgccttaatttaaagctattccagctaggtctgtttcatattactgtaatgaagataatagccaaaacatgataataaaactaacaaacccctggaattgttaacacagatacactgtcaacaatttttctacaaaaactgccatgtcagcttaagtgatcttttcttctctgaacagttacagcatttaccttctctaggcttaggacccagagatgcaaagggaaaggcaagtgttgtgggctcaccccccacttctaatataacagcaataataatagataaaatgtatatcgtacttaccacgtcccagactgtttttaaatgctttaactactccattatttttaatcctcacaacaatcccattattagtccatgtactaacaaggaaattgacccagagttgaggtaaatagtcccaggtcataaagctagttcatagaactagatctagaaccctggcctccagcactaaaaattacataaataaataaataatctttgctcacttatttttttaaagaccagtgaactatgctcagcccaggctagactcaaactattgggctcaagtgatcctcctgcctcagcctcccaagtagccaggactacaggcacacaccatcatgcccggctttcaccattttttcactcttttggttcagtttaagatttcatttagagaaaaaaggttttataccatttaaaataaaaacattgagcaccactagtctatatagtttatttatctattgccactcaaactctgatgtcatttttatggtgttctggttgcactgtttaattctgttagttaactttccgtatgttatgccttgaactgcatacatgtacgtagaaactcccacacgtaagtacactagactggaagttcttagagaacttatattctttgtattaggttggtgcaaaaggaactgtgggttttgccattaaaagtaattaatatctcctatgttgcatacagtacaatgcattcacaaataaattttttgagaaataaacttgatttaactgttcaaataaatttttatcctggggtaaatagttttagtttaaactatgctactggtaataataaacaatccttaagaacatcatatgagacagcagttctgcccaacccactcccaatttcttacccatgcggtgtcactaatcaatttataggttggaacaagaaaaaagttttacattacagaactaataaagcatactttccctgcagagggaccactactgtgacttaaaggttctaattaagtttttttctttgaagcttagtattcaaatctgcattcttacttgattagtattcaccaccattatttttatgcagatcacatgaaaaatgaaccctatgtgccagaataacttgcaagaaattactattcatcagcatgaatcaacaagcccacaattagaacagtgtccactgggaaaagtaaaaaaaaaaaaaaaaaacttttactaaggtcatataaaatgaaagtaaagggggaaaataaagaattcatttttgcattgaaaatcatacaaacgttttcagcagaaaattactatgactattattggggctcagaaaatgatatcctgaagtatggtgctttcatatgctgggcacttccgaattttaaaaaaacagaagaccttagaagctgcctcagaaccaaggactctgtaaccttctcctgtatctctccaactcccaaagcacagagaggggctctctctggaatttccttatcagactaaggaaactttttccttaagaaatacaattctcttaaacctcctccccagaaatctcattaaattaccaggaaagattaacctgagaagaaaagaatctataataagtcattgccaagaccagacagactgttcgtctgttcttcagagggcagctttgagacattacccgagagacttcaactgcataatacaacaacctctgttcaccctacagttcctccctcaacttcccataacttgtgggtcccattcagtttccaaagagaaccatttacaaactactgtctgctccttggatccattaaactctcctaaaatcactatcccccaaaattgcctatattcccccatctccctgactgctagaaagagagtgccatttaagctgtggctatctggcctttctgttacagcccaacaggttcttcttacctgctgcccagaaaagccaatacacggagaacagtaggggtgttgcagcagagaaagagtttaattactgcaaggcagctgagcagaaggaggggaggtatctctcaaatccacctcctcgaaagcttggagcccagggtttttaaggataatttggcaagctgagggccagggaatgtatgctactgattggttggagatgaaatcactggagtgttggaactgtcttcacgtgctgagtcagtttctaggtgggggtcacaggacgagttgagtctgttccttggtatgagtcatggtccagatggcatcagtcagtttaccagaatgcaaaggtctgaaaaatatctcaaaaacccatcttagggtttacagtggtgatgttatctcaaatcttgtgacctccagcagtaaccaagctagggaacaatggctggttatctcttcttcactgtgcttattacttagcagaattcaggcccttatcataattctaatcttattgactttcattagttttacaaatgcagtttcagttcccaagcaagaaggggaccagtttcaggaagggactattatcatccttgctttaaagttaaactgtaaactaaactcctttttagttagcttgacctacacccaggaatgagcagatagtcagcttctggggtcagaagcaagataaagtcagctgtgttggatttctctaaccatcataaccttagcaaggtggtttcagttctctgagtctcatatactgtgtggcccctgtgcttctgcacattaatacatttatatgcctcttcccctgttaatcagtctaatgtcaggtcatttcagcactttcaaatttcagagccagagggggaggaaaaattatcttcacacctatactctctaagaccaaaaagcaacagacattctgccacatgctacaagacggataaaccgacaaatattatatggttccacttataagaaacatgaagagaaagtagagtaaaggttcccttgtccccctctgccacagagggagtggcttgcttcttcagcgccctgctgctcaaacctctagggggagcatacagatgggcacgttgtggggctcggaccccatggcagtgtctagaggtgtatgtttacagctcctgaagccccagtgggcatgtgttacaaggtgctcttttaatctagccgtctgtaggcagcttgtgttagtcagctcaattagacccccttccttatcacaaggacaaagggatttctatatcctggggtttcttgctttggtgaactggaagaatcagatcacatgtaggcttggagaataagtgcaaggttttattgagtaaagtagctctcagcagatgggggagccagaagggaaatggttttctcccggagtcgggcgctcggtgacctgggctctcctccaaccgtcccagccaaactccacgtcgttctgctggccgacggcctcccagcgtgctggcatctgttgctgtgctcttctgcctgcgtgctcccctttgtcaggcctctgagcccaaggtaagccatcatatcccccgtgacctgcacgtatacatccagatggcctgaagcaactgaagaactacaaaacaactgaaaatagccagttcctgccttaaccgatgacattgcaccattgtgatttgttccctccccaccctaagtgatcaattgactttgtgacaataccccctccccgcccttgcgataatggactttgtgatattcctccgcccttgagaatgtaatatcctttgtaatatcctccccacacttgagaatgtactttgtaagatccaccccccactagcaaaaattgctcctaactccaccgcctatctctataagaactatagataagttcttatagggataaacctataagataaacctataagaactaatgataatcccaccaccctttgctgactctcttttcagacttagcccgcctgcacccaggtgattaaaaagctttattgctcacacaaagcctgtttggtggtctcttcacatggacacgtgtgacaccctccacgtcctcccgatgtccggccacttgtcttcttccaccaatgtgttcctctcaccctccagctgcttctgtctgtgccttgctagggtcttgggtttttataggcccaggatgggggcgtggtagaccagggtagtcttggaaaatgcaacatttgggcgcaaaggcagaagtgcttgtcctcacctaggtcgatgggggtagcgccctagccagggaccatgccctcctctacccagcacttcccttacccccttcctcatcatttaaagggaccacactcttcccttcccagcactcccgtatcacagtcagtggtggcactggattctcataggaccactaaccctattgtgaactgcacatggcagggatctaagttgcatgctccttatgagaatctaatacctgatgatccaaggtggaatagtttcatctagaaaccatccgcccccctcactctatatccctggaaaaactatcttccgcaaaaccagtccctggtgccaaaaaggttggggaccactgttttcagctaaaaagtctgtcacgacttgagctgtggctcatgcctgtaatcccagaatttcgggaggccgaggcagggggatcacgaggtcaggagatcgagacttctccatcctggctaacacggtgaaaccccgtctctattaaaaatataaaaattagccaggtgtggtcgcacatgcctgtagtcccagctactcgggagggtgaggcagaagaatcacttgaacccaggaggtggaggttgcagtgagctgagattgtgccactgcaccccagcctgggcgacagagcaagactgtctcaaaaaaaaaaaaaaagtctgtcatgacttgatatagcatcaataagaagctaatacataaaccactcgatgaggagtttagaagatgaagttgaactgaaagtacagcaaaaagaaaactgactccatcatgcaagagactgctcctacagcttggggttggaagtaaataaaataattaaaggcacagtgacttcacagcacgcaataaacatgtattaagcacctacttcctaaagcccactgcagtcaatgataattcagtcaagctgaaatcatcatcatccaaggttcgtttgtaaataatttaacagtttggagagaatatgtgaagaacaacagttttatttccaagaattcatgaccttatctagagaaagtttatgaatggacagagaagatagtcttatatttggcatgatttcctacgcaggtgaaagattcaactgcccaaaaatatctgatctttggcttgttctaatatagcaaatgcccactaataaaaacctttcaagataaatcttcaaaaaagtattaaaatggaaatgttaacaagaaaggtagtgcccactaaaattatagcataggttagggaagagaaattgccgtggagcagggcaaaaaatcattagctggaaagataaccaacccagtttggagggattaatgcagtaattgatgaactttacctttttctttgtctgggtgctgaagtatgactatttttataagacagatctttctaggcagtccagttactatatgtcaacacatagccttgtaaaagtataatatcctataaagaaataaactctaaactcctcaaatagctattcttctctaatgtttacactgtatatttttatctgataggtaagggtcaacactgtttgcatcattaactggcaaggaataatcgaaattactaattacatttagcatgtctcatattgatgaaacaacagatgtttaaggaagaagcttctttaatatctactaacattatattatgtttcattgtattacacaaaactaccaataaggctaaagcagttgtaccacttttatttaccttacaacaaagaataaatagcttgacaagatccttttaaaaaaaaaataaagtgccattactaattctgtaaaccagtaaaagttaccaaaagaattttaataaaaagatctcaagacccccactgtattttgtaaaatattaaaggcagtaaaatgtaacaaaataaaatagaaaaggtgaccttcaaatccatgaaagaaataagcaaaaaaacaagatgaccttaaaatgaaagttctaatgtcatttcattattttattgtaagtcacagagcccccaggtctatattaaaggcaatatttataagacttaaaatactaaaaaaagaaaaaacagaaaaagactaaaaaccatctacaataattcagaggtatttgaaaataatacaaagcaattaaaaacagtaaaatagaagagatgattaagtctaaaagcagctcagaaaggcctacagctgagctactgctcagggagagggaagctgagctcaaagccccaaacatcaagtgcaatgtgaggaacagaacacactcgaaagctgggggactgaatctgagtcagaagcccctgaaccaagagcgccaagagcagaagatggatgtgccagctcaaaagggagagagcaaattcacctttcctctgcctttttggtctactcatgccctcaatagactgatgagggtgatctttaccagtttgcacattcaagtgctcatctcttcccggaccactctcacagatacaaccaaaagtaatattataccagctatctagacatcccttagcccagttaaccatcacaagtaaggaatggtgacatggaataccggagacagaatagcatgacactgtgaaggccctttgatgataagccacagatcaaagaatactagggcaaagatttttgcataggaaaatgacataatctctctactacatatttaacctgattaaaatggatttttgcacagacaactaaggaagaggccttgttaggatcttgtttagaataaatagataaatatatatattatagttggataggactttaaatattgcctgatcccattccttcatttatcagactcagaaagtataatctcctcggggtcagctggaaaattagtgacaaaggctacaatgtttgcctttttttttaatttatttttttgagacagagtctcattctgtcacccaggctggagtgcagtggcatgatctcagctcactgcaacttccacctcctgcgttcaagggattctcctgcctcagcctcctgagcagctgggactaccagagcccaccacgcccagctaatttttgtatttttagtagagacggggtttcgccacgttagccaggctggtctcgaactcctgacctcaagtgatccacccgcctgagcctcccaaagtgctgggattacaggcgtgagccactgcacctggtttacaatgttttcaaacaatgaactcataagtactcttatatttattatgatttttttttaagatagctctatctcccagaatttctacaaccacctctttaatgaactgaagtctttctttctttctggccacaaatatttactgaacccctactatgtgccaggcactgttctagaggataataacaaaattaattctctggttagatctaaaattcaaaagaagaaaaaaaacaataaacaaacacatacatcacacagtggtaagtgttaggaaggaaaatggagtgagatgacccggcgcagtggctcaggcatataattccaatcactttgggaggccaaggcaggcggatcatgaggtcaggagttcgagaccagtctgaccaacatggtgaaaccctgtctcttctaaaaatacaaaaattagccgggcatggtggcgcatgcctataatcccagctactcaggaggctgaggcaggagaatcacttgaacccgggaaacgaaggttgcagtgagccgagatcgcgccactgcactccagcctgggcaatagagtgagactccaactcaaaaaaaaaaaaagaaaaagaaaagaaaaatagagtcagaaggaaaacaagtgcagaacagaaggtattataagtacacagagagcagccacagactaccatctcataagatggtctgcatgaaccaggagcagtggcttgtgcctgtaatcccacctcctagaggggatgagatggtgggatcacttgagtccaggagttcaagacaagcctgggaagcataacaagaccctacctctaaaaaaatgttttaaagtagtcagatgtggagacgcacacctgcagccccagctacccaggagcctgaggcaggaggattgcttgaggccaggagtttaaaactaagctgggcaatatattttatctcaaaaaaataaaaaaaaagatagcctgcactataagaaatccagtagaagagtggtccccaaagactagacaataaatgagaaaatagggagcaggtaagcagcctgtttaaaagagggagggagaagaaaatgaggttgaagtctaagtttcagaacaagtagaatcttatagaccactgtagaaactttgccacagaagtttcccccagaaacagtgcaaaccaggagacaatggaacatctttaaagtgatgaaagacagaacaaaaagtcaagccagaattctatatctagcagaaaaatcattaaaaataaaggcaaaacaaaaattccagacaaatgcaagaagaattgggtaccagcagacctaaagctagaaatttttaaggaagttcttcaggttaaagagaaaggataccagctggaaacagatgaatacaaagaaatgaagagtgctagaaatgttgtaacaatgtaccgtggggtttataacacgtacaagtaaaatgcatgataaaatagcacagaaaataggaggggagaatagaagtaaactattgtaaggttcttacattatatattaaatttatattattttacagtagattatgatgagttagagatagatgttttaaaccaaaagcaacaacaaacaaacaagtatagctaacaagtcaacagaagagataaaatggaatattaataaatactcaaaggaagacagaaaaagagaggacaaaaacaacaaaaataaattaaaaaaataaataaataagtaaacttactaaaacatggcaagaaaaatgcctaccaagcaacatatttaagctggtctgtgttagtgcatctgttgggaataaagctgaaaaccaacatctttactaattgatataaatgtctgcctgaagttttcacagatgatttactgtaatatggtcattctacattgctttcctttccatctgtcataaaatagctgtgtatgattttcaaaattaaaaaattaactttaattagccaactagtttactgataatatcttctcactcaaataagtttttgaactactagacatcgccaaataaaaatagcagttgaggatttgtaaaaagaaaattaagtcaaatagttatttgcaaaatcgttttatcatctttggttcatggaaccattatgtttatcttatatatgctacagcttttttatcaacatgcaaaaagttgtcacatcaacatacccacttgcaaaaatgtaattatactttatataatttcttatatactttacatagcgataatagtaatcaagtactaactatgatagaattcatattggcggagataaatggagcaaaataatattgcttactttgtaaaaataaataattatcttattgatgttgccatttatcctacttgattctatttaatcggcaaaaaccccaggctcaatgtaaaactggtcacagcaagactaggtcagatctctttccaaagtgccagtccagacttctgagtgaccatgggcaaagcacatgcggtgagtggtagaggaaccccaaaactttttcaacacacaccagaaaccgcaaagttacccccacccacatatggttccattcagaaacgaccacagctctcctggtaccggagatacaacaccaacctagataacaaagaccacagagtacatccatctcctcagtttggtctgtaactggagtatcttctacatctccacagcacagatccttggaacgccactgtaacataagctcagcactcaccattctcttacatgcctaaggctttctacagtaagccacagccactctctgcctgagagtgttcactggctgggagcttgctgagacaggccagaaaccagagctggacaagagtgaatgaataaatactcccgcttctttgccctcaggtaagataactatgaggtagattccatgtagcttcacaaaagtacccaatgggattgagcttcagttgccaatagttgcggcctgttcattagcataccctgtagtggcttcattctgtcttacttactcagctctttacaggtgcttcctgggatcatctccctaataaactacttgcactcaaatccttgattactttaatgccatccttcagaatgatgccatttcgtccaagaacaagggatgcctttagttttgttcagttctactttcgggcctttcaggagtgctttaaagttttcttcctgtaagttttgtacatttttaaagtttaattgctgagtattttatctttttttcttgctattgtaaatggggttttctcttcgattatatctctttttttttaagactagtcaagcgcagtagtaacaagtggagaaagactagaacaaggagtttaatctataactgactgaaaagtcaattgagataactcagttggacctttggaccagccttccttataccttctaactcattattgtttacatttatgaaggcttttgatttttccatgttaattttatcatacctattaccctattgagttattttactgagttgggattttttaacgactttattgagaaatcatttacatgccataaaattcactgattttaaatgtactattcaatgggttgaagtatatttagagagctgtacagccatcaccacaatgtaattttagaacagtttcatcaccccaaaaagaaacctttaggcccattaggagttactccctatccctaccccatctcgacctcccagccctacacagccactaatctactttctgtctatatagatttgcctgttgtggatattttacataacgaatcatatgacatgcggtcttttatgtccggcttctttcacttagcataatgttttctgaggttcattgagtaaggttttatcattgatttactagggtttttttaagtaaaatgtcatatgagctgcagatagaaatcattttccaattacaatgcctccaactgtttcctcctgtcaagtgcttttgttaatactgccagtacaatggtcccaacctttgtgggaatattcttagtgtcttcctaataaagtaaagtgctgattatttgatactttaactctgagaggaaaatcatatgtttctatatatgtcaccaccatattacattaactagaagccattatttgttcatctacaacaggataaaataatgtctgccctctctactttacagaaatcctaaaaagaaaatatatataaaatattttataaacaataaaactctatgtaaatttgagagcctatttactataccataaaaataattttagaaaccactgaactcctttgaaagtgtgtgtttttaactactaccaaggagagagaagttagtagacaagaagcaaggcgactagatcattcagccatccaggtatgtaaacaaagaaggaaagaagctagctacagaaagcaaatgtcatattggaacacactgagttttctaagttcctctgacatatttctggtcacagaactatcaccaaacttaaagacctaaaggacttctaatattaaacattaaaatagtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctactcgggaggctgaggcaggagaatggcgtgaacccgggaggcggagcttgcagtgagccgagatcccgccactgcactccagcctgggcgacagagcgagactccgtctcaaaaaaaaaaaaaataaaaaaaaataaatgtgagcatacatacatttaagaaagattaagcaggccaggtgtcgtggctcatgcctgtattcgcaacactttgggaggccaaggtgggaggatcacttgagcccaggagttcaagactagcctgggcaacacagggagactccatctctacaaaaattttaaaaatcagccaggcatgcctatagtcccagctgctcaggaagctgaggtgggaggatggcttgagcccaggaggttgaggctgcgatgagccatgactgtgtcactgcactccagcgtaggtgatacagtgagatcttgtctcaagagaaaaaaaaagtaaagcagaagaagaatttagaatttagaggtatgcttaaaaggttaaaagattcttaaatccttaacttattacagaggaattccaaatacagacatgaaaatgggggatatctacatgactgaaagtaactgaaaatatctgcttatctactcaatgaaatgttcaaatataaaaaaattttagacctcttgacaatgtaggaattgacagccagtaccattattagtgcttatttgttaaagtaagggggaaggaaggtagttcagttagctcttgtaaacaccctcggattgatttgttcaatcctggaaaaaattggtctatgcaatagtaattttcacatttttagagttcctttaacctactgtgtaaagtatgcagtgggaaggaagtcaaactagttacttaatacttatctttaagttgaattcaaattagtctcagagttaactaaccagtgtaagagttagggtgtttttcagttgcaaataacaaaaaaacagatttgcattaaaaagaaaagaaaacccagatagtgggcaggtttcagagttggttagaaataataatgacaacagtaacaacagcaaatactatctgtcaggtactgctctctccattttgtgtgtattaatctatttaatccttgccacaactttctgagagttgttatcctcattttacagataaggaaattatctaaaggtacagagagcatctattacatttgcccagcatgccacagttagtgagtagcagagctggcattcaaacccgtgcaatctagaccagagcccatgctcttaactgctgattcaaacccgtgcaatctagaccacagcccatgctcttaactgctgattcaaacccgcgcaatctagaccacagcccatgctcttaactgctgattcaaacccatgcaatctacaccacagcccatgctcttaaccgccgatgctctgctgcctcgtgatggcttctcaggctgtgactcctttctctccagttccctctgctctgccctcttccagagctagcttgcagctcagtctggctccccgtcaggaatattatagatgccaatgggtcctggaactaccctgtactcatataaaaggggagagcacaagcattccttcctaccaaacaaaagctctgagtctcactttaataggacagatcaggtattgttcccaccacagaaccaaccaccgtagacagggaataaggttgcccagagttatctatgccaatgggaacccaccacaggtacagtaataagggaagtctaccccaccaaacctgcaaaactgccatgtaatgagctggattggaaagaatgttgagtagaagccacactgtccactgcaaccagtgatactcttgggtgatacaactctaagaaagggaatcaagatataaccttatggtataacttactaaaattcatcaaatgtaagatgctatggattgtaagacatgccattattaaagataccattaaaaacagtatagcactgccaagtatcatcttaagaggccttcaaatgtaggacgcatcctaatttcagttatgtcaaaaatgtaggaggaaacgtccatcttacaataaaacaaaaatatgaagtgccatcagctggagttgtaaaaatccataactgctttcccacatatatctacataagtctaggctatgactctatacacaggctgagaaatgaaacagcaatcaaccctgctgtgttcccagaacttaagatgaaagatattaactaaaagagtcgtcagaggcctcactcctcaacccctcaatcaaacaccatgtcagacaagcaatatccaccatatgccaggcacagtgtctgggtcctacaagggaaaatgtcttaactcctgcctcaaggatatgactggcaagtactaaataatcatacgagaaacggtaactcctgcctcaaggatatgactggcaagtactaaataatcatacgagaaacggtaactcctgcctcaaggatatgactggcaagtactaaataatcatacgagaaacggtaactcctgcctcaaggatatgactggcaagtactaaataatcatacgagaaacggtaactcctgcctcaaggatatgactggcaagtactaaataatcatacgagaaacggtaactcctgcctcaaggatatgactggcaagtactaaataatcatacgagaaacggtaactcctgcctcaaggatatgactggcaagtactaaataatcatacgagaaatggtaactcctgcctcaaggatatgactggcaagtactaaataatcatacaagaaacggaatgaagtaatgctgttaaatggatatcaataaaatacaggggctcagaaaaaggaaagattaatatagactaactggaacagagacagttccagcatcaagataacatcagagctgcctgggcatctgtaagaaatgaggatctatttaagagaggaaggcaagaagcaagagtaaataacatggaggtatttcagatcacagtagtagaaatcaagtacttgagttgaactagagcgaaggccgtatgtggcagagtggactaaaaagctagaaatatagtttggagccagcacatttggtaggcaagaagagacactgaacattcttgggcagagaaatgacattatcagagaggttggagaagaatccctaacgagttgtttgcagacactgggcttacggggcttgtgggacatctagggagttttcactgaaactgcccagaagccacccagatataagtatggaatccacagaaagatctaagctaagagtttttatctgggggtcatcaggactagatgataactgaagttatgaaataaatgacattttcttaggaggatctgacatgccagaaaaacaaaggagcccagagaaattacctgaggaacgtcaacattagtggaatgagcagaagagaaggagcttatgtagaaaaagcagcagaaactacacaacaagaggaaggaaaaccaggaacgtgggaaaagagtatgtaagaaaagagagaagttaatactgaccagtttcacagcaagatagaataagaactgaaacataacccctgagatttagattattgatgagctggctgaaagcagtacacatggactagcaaggatggggtagtccacacagggaggtcagaaaaggatgcttagaaaagattgcttttgagctaagaagttaaccagataaacaggaaaaatcaccaaatgtaagggaagaaaaatagtatctacaaagaataggctggatccaatacaaaaatatgtatcttaatcaaaaaaaagaaaaaaacaataaacgcacacataggatttttacattcaacaagcataactaatttgttacctcacacaaattgatcttttgctttaattacaatgctaactttttaagaaaaagaacccaattaaaaatccagcaaatacacagctcagcaaaatttgatgaaaaggtatgcaaataagccacaccttttgtatgacctcttgctaaaaggagcaactttaggccaggtgaggtggctcacacctgtagtcccagcactttgggaggccaaggtgggtggatggcttgaagccaggagttcgagaccagcctggccaacatggtgaaaccctatctctactaaaaatacaaaaatcagccaggcatgctggtgtgcgcctgcagtcccagctactcgggggaggctgaggcagcagaatcgcttgaacccaggaggcagaagttgcagtgagctgagatgccaccaatgcactccagcctgggcaacacagtgagatcccatctcaaaaaacaaataaataaataaaaggagcaactttacatatatctgctatacaaattactctccatttctgcaacaatctgtttaactctaggcaacaagttcaatctcaaatttcattttgactcaattcttttcttaaaaaggattccatattttataatagaaagagccatgaaaaaactctaacttttatttattttaggaattgggaaaatcattccattcctaaaatccgacatatctgactatactctggaaaaaagtatatagtctggcaactcaatagacatgtattttttaaaaatctcactgaataattgcagataagacaaacaagagtaatctaacaattatgccaaacttagattggactacatgtgtgaaagtactacctctctagcactttctccaaggaaactatcagaaccatttattttccactgcataatagcagaactatcagttatgtgacatcctataaaaagacaaacacaatttctaattatatccattctttcattttaattactctagagagtgattacatatttaacttggctatctttaaaaaattaagttgctttaatgaaagtattttagatagctacaccaccatacatcaattagaaagttaatcattccacttgttctcacaaaaagattttaaaggaggtggagaggtggtgtttggtgctttataaaagttaattagagggcacccagaaagagagatcatccaggaaataaagtttatcaaaaatccaaaatatgtaatctgcacagtgtcaagaaacagcaggagattctctttaatgagtttactcatgttcactttaaaagaaaatcttcagttcacgatgtgaggttgagttttaaatatactggaagacttctctgtgtaacagactgtaagactccactcgctcgcttggtcttgactgcctaactgatggcagactattatctaaagcatattcctactctaaaggcagccttctattttacagtgatcttgctgtatacttcacagtcacactcatcattacaaaacattccgaaagctttttttaataagttttcagtgtttgaattatcatgatcactccctcaaattaattactaatatgataagaaataatcaaggttaagttgatacttaatttttggccaaagcaggttcaatggatctatcctagatcaatagataagcttaagaatgcatttctggaagtcctagccagagcaatcaggcaagaggaagaaataaaaggcatccaaacaggaaaagaagtcaaactctctctctttgcagacaatatgattctatacctataaaaccctaaagactctgccaaaagactcctggaactgataaatgacttcagtaaagtttcaggatacaaaattggtatacaaaaatcagcatttctatacccctataacattcaagctgagggtcaaattaagatcacaatctcacttacaatagacacacacaccaatatctaggaatacatctaatcaaagaggtaaaagatctctacaaggaaaactacaaaacactgctgaaagaaatcagagatgtcacaaacaagtggaaaaacattccatgctcatgaattagaagaatcaatatcactaaaatggccacactcgcggtggctcacgcctgtaatcccagcactttgggaggccaaggtgggaggatcacttgaggtcaggagtttgagaccagcctggacaacatggtaaaaccccatctctactaaaaatacaaaaattagccaggcatgctggcacgcgcctgtaatcccagctactcaagaggttgaggcgggagaattgcttgaattcaggaggcagagatggcagtaagccaagatcgtgccactgtactccagcctgggtgacacagcaaggctggctccgtctcgaaaaaataaataaaataaaatagccatactgcccaaagcaatctacagattcaacgctatgcctatcaaactaccaacatcatttttcacagaattagaaaaaattattctaaaatatagaactcaaaaagagcccaaaggattgcccaagcgattctaagcaaaaggaacaaagccagaggcatcacattacccaacttcaaagtatactataaggccaaacagtaaccaaaacagcatagaactggtacaaaaccaaacacatagaccaatggagtacagagaacccagaaataaagctgcacacccacaggcatctgatctttaacaaagtcaccaaaaataagcaatggggaaaggaccctctagtcaataaatggtgctgggataggctacctatatgcagaagaatacaactggacctctacctttcatcatgtacagaaattaagtcaagatggataagatttaaatataagaccacattctacaagaatcctagaagaaaaccattcttctaaaggattggtttaggaaacaccattctggacatcagctttagaaaagaatgtgtgactaagtcctcaaaagcaattgcaacaaaaacaaaaattgacaagtggaacctaattaaaataaagagcatctgcacagcaaaagaaattatcaacagagtaaacagacaacatatagaatgggagaaaatattcacaaactgtgaatttgtctatttgtcatccgacaaaggtctaatatccaaaatctataatgaacttaattcaacaagcaaaaaacaaatgaccccaatacaaaatgggcaaatatatgaatagacacttctcaaatgaagacacacaagcggcagacaaacatgaaaaaatgttccacatcactaatcatcagagaaatgcaaatcaaaaccacaatgagataccatctcacacctgtcagaatggcttttattaaaaagtcaaaacagaacagatgctggcgaggctgcagagaaaagggaacgtttatccactgttagtgggaatgtaacctagttcggccactgtggaaagcagtttggagatttctcaaagaacttgaaacagagctaccatttgacccagcaatgccattagtaggtatctatccaaaagaaaagaaattgttctaccaaagagacacatgtacgtatatgtttgttgcagcactactcacaatagcaaaaaacacggaactaacctaggtgtacatcaatagtggtttagataaagaaaacatggggtgtgtgtggaatagtattctgctccccatggaatacttagccataaaaaaagaacaaaatcatgtcctttgcggcaacatggaaacagctggaggctattctcctaagcaaattaatgcaaaacaataaaaccaaataacatgtagttcacacttataagtgggagctaatcactggtactgctggacataaagacggcaacaatagacactggtgactattaaaggagaagaggaaaggaggaggcaaggattgaaaaattattgggtactatgctcactacctgggtgacaggatcatccctatttcaaatctcagcattacacaatatacccatgccacaaacttgcacatgtattccttgaatctaaaataaaagttgaaattatttttttttaaagaatgtgtttgtgattatctgaaattattgcaaaatgtatatacatttttttccaaagaggtttcacggatttcataagttaactgttttattctatgaagagaccatggaataaacaaaacaaagcagcaaaatgttaagtgaaaactttatattcagactctgaagcttctttggtaagggtagtgtgttacgcaaagaggtattctgagtaactgtaatactagataaggaacagtcaggacaaagccactgcttttctctaagttaggaaaacatcaggaactcctgagaattccaaaatagcttgaatgaggaagggggaataagggaagagtaatagcgttgagactctaaatgatagaagaattccaaggagaagatacaagaattccaagaattccaaggagaagatacaagaattccaagaattccaaggagaagatacaagaattccaagaattccaaggagaagatacaaggaaactggacaaaacacgctaaatgaagctacattaattagaatgtcccacgtggcatttgaatttccctctattagagtttttgctacatttccctgaaggtttatcgagggcagacactgaccttaatagtctttgtatcacgggttccagcacagtacttctcacatagttgttactcaacatttcctgggtcagtaatgaaaacatgggttggaaataggtggcaagtttttttaaaattattaaaccagaagctttcagtgggtagtagttacatattcaaatttccttcacccacttgagagagaaaatataaaggctatgaaatgtgtcgggagaaaaactatgaaccattctttcttatttgaaaaaaaaaaaaactatacaacaatagaagaaagttgaaaaagaacctaatcttccttcatggaaacatggacttaaacaaaaaaagaacctaattttcctaaagtgaactaaaagttacaaatttcaatctccaataattgaaggcaagaactttgttcttatagactatctcaggcagcagtttaaaaggggggcctacaatgttttcccctttgattttaaaataattttacacttacataaaagtcacaataatagcacagaggattcccatctaccccttcactcagcttcccttaacattgacatcaccacagtaatacatagaaagtatctaggttcctgcctccctagtctcctccgatctgtcataattcctaagtctttccttgtctttgacacttgatacttttgaagagtaatgatcagttatttaggcaggtgtcttgcctaaatcatgttctttttctgttccacaaggtaaagatgtatttagatgtcctgcttcgttagtctcctccaatctgtgacccaacatgctcccgcccccaagggcaggtttacttctattacttctattttccccaggtgtaaagggttttcaccagagccccaaaggtaatggtcattgttttgtcctttctctgctttcattcagtagaagggaaaaggacgatagggaataagggtcctgccagagtttctttcttttttttttttttttttgagacagagttttcactctcgcccagactgaagtgcagtgacacaatctcggctcactgcaacctccacctcccgggttcaagcgattctcctgcctcagcttcccaagtagctgggattacaggcacccgccaccacacccagctaattttttgtatttattagagacaaggtttcaccacgttggtcaggctggtctcgaactcctgacctcgggtgatccactcacctcagcctcccacagtgctgggatttcagagtttcttactgtatctgcagcagctgctcttctcctagagacaaagaatgctttctcaggaatctcacctgtctttttgggagcacctggtagagtttttggagaaaaagcctacaggtgggtatgaactcccctcatccacagttcccagggtcttcacactttcttgccagcccacatgcagcatccatcaatttggttaactattctagctgaatgcttaccagtgtccagctgtgggtgccccaggtaagcaagtgctgatgtctttccctacatctgtctcttcttagacgtcaagctagccgattgccctataacctcagcaatctgatgggttaaaaaacaaaagtcatgaacttgtcattgtccagatgtttctgtgtttagtcttgcttttaagattagaagccatgctttttctgtacacaattttgtttttattaatgcgtgaatttgtttgctaaaagataacgctatgaaacaaatttaaagtttattgaaaaatcaacttaaaagcagcattccaaaatattctaatataatttttaatcttaaaacttagagttttgactgttgatcactgtcattttttccagctgttgttatatcaagaaaactctcattatttccataacaataaaattcaaaactgaaatgcaataatgcatgtggacataaattatactgagaattcaacctaataaaaaacacataacagctgacaatgatttcttaaaagcatttgcttaaagtttgtcagaatgctgggagaataccaattacgtattcatagtcctcataattttgttttacaaaatattttctcaaatctcttgggagattactatagggttaaaagctgttttaagatcaaagatcaaatagaggggggaaaaaccctgtaattctctactgcagctcattgatctttcccatctgctatgcaaaaaaggagatgcatgttaagtttgaaaaaagaaaatctttttaactaggaatgacagcatactgattctggcaaacgttcagagggaatttttatatatgagatccaactcccttttgccaaaatataaatgatgttaacaataggaaaacaaaatctagtcagtagtctcttatttatatatttcttcctgcaaatatatcgtatgatcagatttctaatataaaacacacatagtaaaataaattttcaaccatcaagagcacaggcttaggggtgaatgataagagacaagtggagtaagacactgaaaaacgaagtcaactcaggaccagaggaactactttcctggtactcttccctcccttgtatcctccagggattgattccaggacaccaaccccctccctggcccccagcacggataccaaaatccatggatgctcaagtcccttctataaaatggcatagtatttgcatataaactatgcatatcctcttgtatactttatatcatccctagaatacgtataacagtggtccccaaccgttttagcaccagggaccagtttcgtggaagacaacttttccacagatgctggggcggggggcggagtggggatggttttgggatgaaaccatcagatcatccaatcatccgatcatcaggcattactttgattctcatactgtgagatctagtgtgcaacctagatccctcacatgcacagttcacaatagggttcacgctcccgtgagaatctaatgccgctgctgatctgacaggagacagggctcaggcaataatgctcgttcacccgccactcactccctactgtgcggcctggttcctgacaggccatgggagtggtaccggtcctcggcccgggctctggggacccctgactatgctatgtaaatagttgttatgctgtattggttttatttgtactatttttattgccacattgttattttcgggggggggggttcccaattttttatttttatttttttaagagacaaggtcttgctatgttgcccaggctggccccaaactcctgggctcaagcaatcctcccatttgagcctccctaggaaatgagactacaggcaaacaccaccacacccagtccaaatattttgaatccaagcctggctgcatccacagatgtgaaaaccatggattcaaaggattcactgtatagtccaacaattcaagtttccgtggactttatgtaaaagcctagaagccttctcatgtatcttcaccttggaaacaataaaaaatacttcccaggaggccaatgacatggcccattttttagaacagaagcagcacattttatctcctgagacaaacgctcataggcacaccaacaattatcacctttggtaaccctcaaagtattttagcatggggcctgtttctttccttagtgtgcctttagcttctctcctctcacagtcactgaattctacacttaaaatgggtgagactgactcttaagaaaaaaaagacagttgtatattctcacactagaagcacaataaatgtgctagaagtactaagtactctggtaggcgggggtgggcggattacttgagcccaggagttgaagaccagcccgtgcaacgtggcgagaccacatctctactaaaaaaacagaaaaattagctgggagtggtggcgtgcccctatagtcccagctaccagggaggatgggatgggaggatcacttaagcttgggaggtcaaggctgcagtgagccatgatcgcaccactgcactccagcctgggtaacagagtgagaccttgtctcaaaaaaaagtgttttagttctttataagtttgatgatatttctatgatcagaagtatgtcataggaacttaactcttgtttatatccattagcctgtggtaaaatcggtttcgttagaagtcattttgcttgaagtttacaacaatctattgatgatgttgagtgaggacttactctacatgagaaataaaaagaagaaaataatcccatcacctagaaagacaaccactattaaaccaatatacacaaaaaatatatagatagagaaaattttatttttcaagacctcagatgccattttggaatctatttttaccacttaatgtgattatttgccccatgtcactaaatatcattaaaaattaacattagcaaaagatacctcccacaaattgagtacttaccgtttgccaagcacgacattagcactttgcagaagttatttcatcctcacaaacagcctgtgaggaagatatcgtcacacccactacactgatatgcaaactacctatcaatatctaatgatattttggatcacaaactaaataatcatgacagtatatttttttaattatgaagtcaaatttataaaagtattttcaggcagaaactagtgatgtaggaactctctctccaaatctagaagtatatatctatgaaaaaaaatatttgggggcataaaaactacgttaaaataaatgtagaaacatgttgaagatcttcgatgtgactaaaaaggaaagcctcattttttactatgatataggagtagcaaagggtaattaaaacaaccagcagcagcactgtgagctttcacagaaagatacaagttcacaaaatccctttcctaatgaccaagctccatggattggggctttcgcatctgtgaccatctttctgaatgtcctggcataccccgtcttttgtattttcctaagaggaagaaatccctctgtgaatggaacaataacctcagtgccatgtgtgtaagactatatatgcctactgcttggttgaaggccactgggaattacacacacctgttagtggggagcaacatggtcctccaatctggttacattacgtagaagtaaattataggtgacccttaatctctgttttgtgcgtccccacttaccctgccgttcgtaagtacacgcacattccagacacatgaagaggagctttttatccaagactttgaaagaaccgactaggagtttacaggaagatctctaatgagtaatagtggtaggtaaaattcacgctgagccagttctttcttggtcgtcatttgtgtacgtttccttactaaagtaccaaaatgtctttgtttcaaggtcatttcacctatggagtaaatgcataatttgtaactacgctgcaaaatttgtggttacactgactccaagttatcttatttcatactgaaaagaaccctgaaatgaaagtaccaccattcactatattgaggaggcaaatttaaaaccaggaagctgatattacctgttactgccaggtcactccttttcggattatcactggagctttcaaatcttcaagagatcagaaagcattccagtggctcaacaaaggcactgaaacaaggacaaaaaatgcctcactgacattttaggggctaatgcctatatttctttctttctttgttttttcccccttgagatagagtctcactctgtcgtccagcctggagtgcagtggcgccatctcagctcaccacaacctccacctcctgggttcaaacggttctcctgcctctgcctcccaagtagccgagaccacaggcacatgccagcatgtccagctaatttttatgtttttagtagagatgaggtttcaccatgctggccaggctggtctgcaactcctggcctcaagtgatcctcccgcctcgggcccccagggtgctgggactacaggcgtgaacttacgcgccccaccttctttctctttactatctttgatgttcatgtatctattcattcagtcaacaagcagaaaatgcctatcatgtgcaaggcactatggaaggcactgaagaatcacacataatagagacacactctcaaggcttttataacttagctgaggaacccaatttattcaccaccatgaactatatcatataataagtgctacaatgtgtaagcgctgtgggagcaccatggaggtgttacttgagtcataccatgaagtaccttttcttcagggaaggaaggaatgatgtgataatccattagaggtatggcacaggcacaaaaacaataaacccttatggaaaagtcttcactaaaagactattgaggccaggcatggtggctcacgcctgtaatcccagcactttgggaggccgaggcaggctgaggtcacgagttcaagaccagcctggccaacccggtgaaaccccgcctctactaaaaatacaaaaatcagctgggcgtggtgacgcacacctgtaatcccagctactcgggaggctgaggcaggaaattgcttgaacctgggaggcagaggtcgcaatgagccaagatcccaccactgcactccaggctgggctataagagcgaaaccccttctcaaaaaaaaataaaataataaaaaaagactactgaaaagagaaaacaaagtaaaagtagttacacagaaaataagaaaatgaaagaatctaatgataaagaaatatactgatgtgaaattggagaccagttggaggttaagtttaaaaatatatatatattttgaacacagtattgaaataggccagaggtttatgaataagtgaagcagacccattaacgcaaacactggtactgcttcctcaaagcttttgtgaaatgaaggaaggcaaaaagggaatggatagatgatcttgggagccagactctggtaagaatctgtgccctgggaaggacggttagttcttccacactgtgcactccacctcagggcatcttatctcccttccagaattcttgcctagcaacttcccttacagtgcaccaggctcccaacttcagattttatgctctactgtatttaaattcttcttatttaaatttaaaaatgtatggtagctcttcctattttggattttgtatattccttccagttgtttttgttttgttttactctcttatgtatttgcattaagtaacattttggttcacatatatacatgcctaagaaattttcctcaacctcctcttaccaatcagtaacactggtttcaccaaggagtaagattctaatgtgttaaaccctatttaatatctttcagtttgatcctcaaactgtacatttctccatctgcaagtacagcgttacattcaccaacttacctaatggaatttgatacatggttggacattactataaattagctgaatctcaatttatttaggaagctctacaatgtaactcctcaaaaggcaacagtctcctatagaatcaatatacatgtaacaccattaagaagcagcctctcagaaaagcgattcagcaattgagattaatgtaatgaaagttattcaggtagataacaatctaattttaaaacacttgaaagaaataagtcctaactcctttcccatacaaatagagatgctagccagtctggggcaagggagggttgggctggtgtagtggcagggaagatgggcacaggaacctaacaccaattttttcacttgtacatttcctaaaagaattttgaaaaaccttgtgctcttctgacattttaggttgacatgttaatttaatgatggcatggatatagtttccagtatggtatatacgtatcttaaatattattgttgcaaccctgcagctgtagatttcactcttttacttaatgaaatatgtccaccaaacaatctaattgttaagcctgttctgtcaaatcaataaatcaaataaaacttactttctgtcaaaaaattcatatttcatttcaaataaaagtgctaatctgccttccctataaaccctccctcaccacccatcaccaccacagacagacaacaatcaacttgattctaaaagaaagaaataaggtatggagtcctgccatgggtttgttacctggaggaaacatctatgattttgaccaaagcagtcatcactttgctatcttcaaattcacacccagaacctaagaattttttttttttttttggagacagagtctcgttctgtcacccaggctagagtgcaggtgcttgatctccgctcactgaaacctccgcctcccaggttcaagcaattttctgcctcagcctcccaagtagttgggattacaggcatgtgccaccacgcctggctaatttttgtatttttggtagagacggggtttcaccatgttggccagactggtctcaaactcctgaccttgtgatccacccgcctcggcctcccaaagtgctgggattacaggcatgagccatcgcgcccagccccagaacctaagaattcttaaatggtccctttagtgggtgaaccagaggatttacactccctgaagcaatcaaatattgtaagatttgtgctgggtcagaagcatgactgactgcctttgtcaagtgggaggaaagcaatttgtgaatggagaggtaggaaggaagactcactctgccacaggtgctctcaggcaaccatattagaaattatcaaatgcagacattgagcatctaaataccattaaaactatttttgcatgcaaaattcctgaaaagtctccatgaatcccgaagtgtatatatacacccactttaaagacaactaatctaaaaaacagctccagagtgcttaactcaacattggaagccaggcacacaaaacgcaaaagctgtcagtcataatgttctaagaatagaagcagaataaagataacaaggcaatgtggtaaaagctttaggatacgcaaatttgacataggggtgcagagcttggattctggaatcagaaagtctggggtttggattccacctgtactacttactagccatgtgactttaaataaatttctttatctccttggggctttgttccctcctctttaagacaggagcactattgatgttgatgatggcagtgatgatgttttaagtatctgtacttcactgaattgttgtgaggattaaatgaaataacacaaggcacttagcacaaaacgtagcatgtagtaaacattcaataaatgctaacacaacattaggagggagagttttacttaataaaatatgtccaccaaacaatctaattgctaagcctgtccttactgtcaaattaataaatcaaataaaaccctctcctgagtgtaaatcactgcccatttttgccagcagtttagactatgagtgaaaagaaggtttttaggaacaccaagccaactcaggcaaaatggagacatattttcaactacaggcctgtcctatgtccctaaaattgccttccatgaatgtaaccccaatcagagtatagtttaaggtagaacataagaatttgtccttcttactattgacccaagggataaacagcactagtaaaattctgcttttttatagatactctcaaatctgtatctgaatttctaaatgcatttaagatgcccggggtctaaaaacatacaacacagttaacaacaaagaaaacgaacttaggagggctgagttagaaaacccctacagctgttaagacagtcttttgcaaaccaagagattaggaatttaatttgtacaagtatggaggggacttccagccacttgtctgagagagcttagtacagataagaaattaatgtgcctgaatgacttagacttaattcttataaacactctcacttctgaaatgggaccggagctttgcctttgagtggacatccaaaaaggaaaaaaaaaacaaaaaaaaaacctgggaataagagaattaacttaaaaactcataaaaagcaaggcattactgtacatctgataagactgaaaaccatatgaatgcataactaatgaatttcccacacaccaagttcatgcaaaatcacacagttaattccatttcatacttttaaaccttcactagaattggttgtttttttaatctttactttcccatctactaaggtaagtcagaagaccctggatgtaaacatatcaattgcctctaaaataaagaccaagtattgaaatagtgaagaggatactgcattgtctcctagtgcttttgaggaagcagagcccaaaatcatggctcattttactactggccaaactgtgaagcagaatatatcactacatgtagcaaataacaagtaagcagagaatcaaagacatcacaatgatatatccataaaaaaagtattatcatatttgtcctaaagacaactctagaaataattctatttatctagtaagaaaaggcatgaccatttactatatataaaaacataatctttcaaagaatgtcaaaaatgaaaccactatattatccaataaattctgtgaccggggagagaaaacctactaatctctaataaatggaacctccacatcagagatattagaggtgctgtttttctaaacccatttaatgtagctctttgagcttgcaacaggatctccatgacaggtttcatttctaaaattcaattaaaacttatctacgatttaaataggtaccatatggggatgaattttaggaacctatgtaacttgaggcatctgatgacactgttaaaaggagttgtctattactgcaggaacacggtaatttagaaatggcatcctaggccgggcgctgtggctcacgcctgtaatcccagcactttgggaggctgaggtgggcagatcacaaggtcgggagatcgacaccatcctggctaacatgatgaaaccccgtctctactaaagatacaaaaaattagccagtcatgctagcacatgcctgtaatcccagctagtcaggaggctgaggcaggagaatcgcttgaacccgggaggcgaaggttgcagtgagccgagatcgtgccactgcactccagcctcggtgacagagccagactccgtctccaaaaaaaaaaaaaaaaaatggcatcctatctaatttaatcacaccataacttagagcaagttttatattttaaactatatagctttcaagtagcaatctcaaatcctataaatgaagactgcattaaaatgttaaatgtattgttataacatttccttcggaaaccagatttaattataggatcatctataatgtcttgcctttatcagaggaattggggaggtaattaagtaagtagagtgtatcactttacatttctggtcccaataactttcggaacactgtgtaacaaaatgtgctatgagaaaagagtacttgtaaaattattaccgtaatacaaataatcaacttcttcaagacagaaaaattcttggctataaaattcagaggaaaattccaaacttatgacaagatgaaaatactgaaatatatttgacatttgaaaacaaaatttccagaagtttctctcacaaatacacgagacagaaactgactgattcagaggccacgcacctgaagttgtctcaccagtcttaaaagattatctcaatacaagaaatgattgtctttccaatatttctttttcagtcttatagtctacagaagtatccacataaggagagctagcaggacacacacaccataaatcacagtaggcaggtcagctctatgcttagtcagttcttcattctacaccttctcccagttagaagcagccccatctcctctggggaattaattgccatgtaatcatcacttggattactgagctctactgtttcacttccagctttttaagagaattgctttcctcccacttttttcaaatagaagaggtgaggagatcaaaatacaacaagcactaatatacccttccccagattcaacatttgttaacaactttccacgtctgcttcctctctacatatgtgtatctgtacgttcttttgctcatccatttgaaaataagttgcatacattttaactcatccctaagacctttggcatatgattcctattaagaataacataatcaaattagccaggcgtggtggcgcatgcctgtaatgccaactactcgggaggctgaggcaggagaattgcttgaacccggaaggcagaggcggcattgagccaagatcgcgccattgcactccagctagggaaacagagcgagactccgtctcaaaaaaaaataataacataatctcttacatgatcacaatacatgatgctgaagccactattctggagaccacgctttgagaaccaacgcacagagactaagataaaactgctgttcaataaatgctcttctcctcatcctctactcttccctttccaaaagtcaactgtcattatcctatgaaaacagaactttgaatatgttatacaatcaatttgttggcagggaatacccatccccaacatatctactgagagactaaataaacaaatggtcaaaggccagatcgtaggtaactacgacccacgacctgcagctacaagcccaggcaaccaacctattatctacaataaccagtctaggaagtcagactggttactgtctagcaactagcccaggaagcccaacaatgcccttaagaatttgtacaaagccacactatctgtgatcatgcctggggaacacagcaagatctcatctcttttttttaaaaaaaaaaaaaaaaaaaaaaaaggacaaaatggccaggaaatgattagtaactgtcagcttccctaatttttgctcctgcttccaatgtaggaccaaccagagaaagccaaaaatgtacccttaactaatcacacaggttgctatgcttttagttggctcacctacagcttcccacaggaacagcctacaaacagggcatacctgaaaccttcccttttttccactctaaagtttaccctgctgggcacagtggctcacacttgtaatcccaacactttgggaagacaaggcaggaagatcacttgagcccaggacttcaagatgagcctgggaaacatagtgagacccagtgtctacaaaaaataaaaataaattagctggacatggtagcacatgcctgtagttccagctactcaggggggactgagatgggagagtcacttgagcctgggaggtcgagactgcaatgagccatgatcacgcccctgcactccacgtggtcaacagagcaagagcctatctccagaaaaaaaataaaataaacaaaagttttcccattcctctgtcttccttgaatctccaccaaattgaatagatggtggtggattcccttactatataaagaaagctctgaataagtagcctttgattgtactcatttgggtagacctcatttatttccacaaccagaataaaatcaattagttatttttgtgatgtttttgctctttaacttagaattccttcttctgagacagtgtgatatggggcaggagggacctgctttggagccaggaagacctgggtttggaaatctgacttctccagcgattaccttatgcaagttctataatctctttgaacgtgagacctgtgtttggaaatctgacttctccagcgattacctgatgcaagttctagaatctctttgaacgcccatttcctcactgatgttctccatgaagggaacaataagcacccactgcttagggctgccctaagaagagaaaataaacacaaaaggacaccgtgcctgacacagagaagtgtcaatgaagtcaggtgctctgactgggctatgttcttcagctttgaaacctttaatcctgtgagtatgaacctgctgacgttaggtgtggaaaggttttttttgtttgtttttaagtaatgttattgggagtatagagccaagtccctcactttagaaactaaaagatgagtgttgcagcttcggcataccgttttgactactgtgacagaaaatgacccaaactagttcatgtaaaatctcatcaacaggccgggcatggtggctcacacctattatcccagcactttgggaggccgaggtgggcagatcacctgaggtcgggagttcgagaccagcctgaccaacatggagcaaccccatctctgctaaaaatacaaaattagccgggcgtggcggcacatgcctgtaatcccagctactcaggaggctgaggcaggagaatggcttgaacgcctccgggaggcggaggttgaggtgagccgacatcgcaccattgcactccagcctgggcaacaaaagcgaaactctatctcaaaaaaaaaaaactcatcaacagaactatagggacatcccagactcccaaagactgagtttcaactgataaataactcaataaatcaggctgctctctcaggaaatgcttgatttgatcacctccgttgttcttctctcaacctgcttcttttgcttactcagctgcacacggccctgaaaaatgcccaccccaagatggcagtgatctataatttcataaagatttgggttacacaggtgtatgcatttgtcggaattcatcgaatggtatacttaagacataggcattccactgcacttaatggatctagtctcatttctgtctccctcactaaactgtgacatctcaaggacaaaaaggaatcatattcgacactgaatcctccacgctggcacaatgcctagcatgtaactgaatctcagtaaatgcgtgattattaaacaaaggaagcaaactgaagaatttgagaaagtctacttattgggatttattctgaaagatgtactacaagttcacattttaattaatgattacattccagtgaattaatataaacgtatttaaattttaatcattatgaagtgaactatatttataagcaaacaattagtgacttaattaaggtgccaactgttcagtgtacatgactctaccaccacctagtgtaaataaatgcatattaccacatttggaaattccctaaagacaaagaatctcccaatggtgggtcacaaactaacatacttcaaccacaaacattcagcaggtgcctgccggtcctggaaattatgccaggctccagaaggacagacacagctcttgtctgtgttgatcactgctgtctcctcagggtttaggagaatggcaaagcactttgctggccttcaataaatatctgttagctgactgacaagattctgggattaaaaggtgactaagttatcttcgggaaagacattcagccattcaaaaccaacagcattttataaacaatgaaatattattctgcactaaaaataaatgagctatcaagctctgaaaagacacggaggaaacttaagtgaatattactaagcgaaagaagccaatgtgaaaaggctacacactatacgattccaactgtatgacatttaggaaaaggcaaaactatagagacagtaaaaggatcagtgatgaccaggagctggggagggaagggatgaatatgtagggcacaggggattcagggggcagggaaattactctatgatatgatgatggtggatacatgtcattacacatatgtcaaaacccataggatttacaacaccaagggtgaacgctaatgtaaactattcactttgggtgataatgtcatgagtagaaggtgatcggttgcaacaaacgtgccattctggcggggggtgtccattgtaggggaggctgtgcatgtgtagaggaagagggtctatgcgaactctctgtgctacgcactcaattttgctatgtagttaaaactactctaaaaagtagttttttttagtcaataaaatttttttactttaactttagatatcaaataagcaaaacccaaatctaacaagtacatcaaaaatatactgtttttttaaatgcctacataaatgctcaataaatgttatttcctcacctccgtagcacaaccgcaactgcttaccccaagtagctgacatgaagtggctgtaaagaagccactgtttcttcatctgtgaaattaagacagcaggactaaatctctcacttcctattctaatttaacattcttttaaattttaaaagaatagatcactaaacctaaacttttctaaaatatagaaaaaggaaggaaactgtcaaatacttacagcatcacacagtgacaccaaaacctgacaacgaacacattaaaaattactgtcaaatctcacttgcgggccaggggcggtggctcacacctgtaattctagcactttgggaggccaagatgggtggatgacttgaggctaggagttcgagaccagcttggccaacatggcagaaccttgtctctcctaaaaatacaaaaattatgggtggtgttgtgcacctgtactaccagctactggggaggctgaggcacgagaatcgtttgaactcgtttgggaggtggaagttgcagtggacagagttcgcacctccagcctgggccacaaaccaagactccgtttcaaaaaagaaacggaaaaaaaagactcatttataaatattggtgcaaaaactttaaaagtaatagcaatgagaactcataaatgcactaaatgaaggataggctataggcacaactgtttactccagtgattccaggagagttcactattaggaactctactcatacaagcaaccatataagtaggtcaaaaaagaaaagttatatgaccatctaagtagatgccaaatagacatgatgaaatttttaaaccgttcctgattttaacgcttagcaaaatagcaatagatgactatttccttaacataatggaaaaatacatttcatatcagtctataactttctaatgttttactggaaacattactgaaacactaaaacaatgacacacacaagcatttctgttgaagtctgggaggaataaagaaagcccaccattgggcttctagattaatattcatctagaagtaccatactagccaatgcaagggaaaaaaaatcttatgtgagttttatttatttaccacacatttttacagtgcttactatatgtcagatactgttctgaacactttacaaatactaaatcatttaattcatataatcgtcataataataaggcagtactattattatctcattttacagagggagagagcaaggcacagagaacataagtagcttgcgcaaagtcacatagctagcaagttagtagaaacaggcttaacacacaagcagtcatagttccagagccggtgcttctcaccactatgctatatgaaacacgatatcggactgaaggaggcggaagtatccatatatgcagatgatatgacacatttgcaaaattcaagggagaaaaaagttgaaacattgttataagtgagaatttagtacagtggtggattacaaaatcacataaaactacgatgcttctatatgtaaacaataaaaacttagaaaatatactataaaaagatgctatttacactactgacaaaaaaggtaaaataactagaaataaaaataagtagatagttcctatttgaataaaaaattacaaccctgctggtttatcagtgaacataaactccaaatttaccaaaagcgaggtattcaaaaggtatgaactgacttaaaatgctcctcaggcacctaagtaaaagccacagggttgaaagcaaaccagccttaaaaaggcccaccgtttcgccacctacctggatcaggtgtatgcaatacacttgagctttgtcagctaacccaattatgcccaatcttttaggccaacccttaacaaatttaataccttctattaccagcccaagagcacggtcatgatacagaaacacttttctgcaaactgttagtaaatctctactacaccttacaacagtccacattttaactactaataaagcactgaagttgggtgaggatctgatggaacaagtggatcttctagtcggctcctattccactttaaggcctaaggttggcagttaatgcccagtcaaatcagattaggtaatacgtgaagaaattgttcacaatgcaaaaaagagaaatcctgaataaacattcagagaagtgtcccctaaaaagtaaggatcattcaactatgaaatgagttaacatgggaaaccaagattctctgtaggaaatagtttaatgggataggtgtgcatccataaagaaactgctatgcattgaggtggggaaaaatgctttaaccgtcaccattagcaccataatcagtcagtcagtcaagcaaccaggcaaccattacttatggagttgctactatgggcacaactctgcagcagtcaaaataaaatgtgaggtatgattccatcaagagaaatatttattatatgcttggagaaacaaacatgaagagaatacaaagcaatacatgaaaagaaatacataaggcaaactaataatgggagaatttctctctgagttcccatatatattacaggaataaaaatctaaggagcaatcaatcagaatagaattttatttcttccaacttttagaagctgaaaagatttggaggactataaaatgtacacaggcaaataatccacggcagtagtaataactgatgagggattattaaaaacacactaaagcctcaaacgtcagcaatgtttatcatcctatttcattaaaacatattcactaattaatttcagtaaccagagttaatttaacaagtcactgtgctaggcttttactgaatgagtcaaaaggaaacacataaaaatactcaaagatttcttatataaagcaacaggactggatgcaagctctaagggcagctgtttaacaatgaaaaaactgggactgaaatcaagtttgtgactgaaaataggcacattgagctctgtagtcacctctatttatagtactgtaataaaagccacatattgggttaaatcaatgtcctcccatcccttagataacccactctacaatacaacaaatttataactgaagatgtagggtgataattcacattaattcagcaaatatttactgagttatgatgctgtgctcagtgcctgaaatgctaaatttaataagacatagacccagcattttttgtttgtttttttaaataaagacacagtcaagtccaagtccctgatctgaaagagctcatgttatagagaatttctcactttgtagggagagaaaaagtattcctttaaaaataaagttccttgaaacagtcctgttttccaatcattaactacctaaccaggaagatagagaattggaaaaccaccacatttgcttataagaactgaatggaatatgaattggaaataaaaatgaaatatctctaaaaccgtcatgctatactggattgaatgtacatcaagaaattgtatttccagtcctacattgagaaattttatttacacaaaatctattacacaaagcaagatataaccagctaatatttcattgagctattaccaaatgttaagaggtttcctagaaagaaatgagttctattaaaagctttagggacactgagcctccaaatgctatagaaaagccagatactatagaaaagccagatactgccttgaggcaaaaatgctagaaagtgatagaatgcgttctttacaatttgcagctaggttattacccatgataaattgataaccattcattaactttgagagcaatagacaactggcaggctatttcatgcctcaaagaatttatggcaaaaatgacaggtgactttgaattctgaaaaggattcttggaaattattactttcatgcattcctttaaataaacttggaggcagatataggtatttgctgctgatatgaattaaaggtcatgattttctacatcaatgataaaagaattaatgtttatcggttgcatcagtctgtcaatcaacaacagatacgtgaatcaggcacttaaagtatatcctgatagctgatatccactctgagtcatagcagggaaaaactatgcaaaaatacatcaataacctatattaaaacagtacaattaagagtaggaattatgtttgcaggttctttgctggccacctccttggtacctaccacaatgttggtaatcccaaaggaatttgtctctggcccaattttcttctcattctccctgtttctaagctgatatatatctaagccttcagctatcacctatctctaccttctccaggaatatctctctcttgagttgctccgattgtcaaccctggcttcacattagcattacctcagtcgattttaagacataccaaactgtgtccctgtgtcatataaattaaatcagtatctctacgaataggaccaaggcatgaatttgttgtttagtttccctaataggcacacaaggtcgagacccactgcttttctagatccatcactccagccatctcctggactggtcagctccacctgaatatctcacaggcacctcaaatttcccatgtaacatacctactcatccaccaacaccaagctaaagcattttctcctctgccctaactgaccccaggagcattaggcagtccttccacctagcttccacagtattctgtctatgcctctgttgaagcatttagcaccatttattataacttatattttccccataagactgtttctttgtcctgctttgttttaatatgcgaagaacccacaaatgagtgggaccagaaggtgagtgatagccaaaatccaaagagaaatcaaatatctataatcaggtctaaggagtcattgcaaggttggaaaactggagacatggctaaggtatcattaagcaggcagacacaagatcaaagttatgaaggaggacacaaggggatgggaatggtgtacccagggcttagctttattaaattccacctagtacaccgaatggaccagactaatccaaatctggctctaggttaaagaaaatggtcctgtaaagtctacttccccaaagaatatcgaatttaagttctcctttgtgctttcacttctacagccttatatggagccttccatctcttgagtagactttttttccttttcttgtatagacttttaaaacagcatcttaattcatgtccatactgatcatctctggccacttcaggctaacactgaccacagagttatatttcagaagaataaatctttcgagaggtgaatgttcaagggtaagaatagagaaaaaataaaaacataaaataaaataataaatcttctccctcatcactcctctattggaaactctcaggtgactcttagaaaataaggtccatgaggtcaggagttccagaccagcctggccaacatggtgaaaccccgtctctattaaaaatacaaaaaattagccagccatgatggcaggcacctgtaatcccagctaatcgggaggctgaggcaggagaatcacttgcacctgggatgcggagggtgcagtgagctgagatcgtgccactgcactccagcctgagcaacagagcgagactctgcctcaaaaaaaaaaaaaaaagaaaagaaaagaaaagaaaagaaaagaaaaagaaaaagaaaagaaggtccaaattctctaccatggcctatacagcctttctcaacttggctgtaaccaatacctccaaccattctcccacataatcaatactacattcacaatcaatattctccatctgttcacaacttagtgcttttatacaagctgtgcgtacagcagaagtacccaatccactgcctacctactatccaaaatttacagatcctgcagaaatagctcaaatgctacctcttcagtaaggctatttataactacaccagaataaatggacatcctcattcactactgattctttccaaaagtttttctggaggccctactatgtgacagtcactagcataaactttcctatagtattttgttcaaacttgagttatgacagttatgatgttatatttaaaacgtatgtgattttatcacctgcatctgtctgttcatttcctgaagataacaagcattattttctggtccaactttcctgtttttctgacttgggtccaagaggggctcaggactccatgttgtgcctaataaagacttccctgatggcaggtcacagctgtgggcacccgagggtcaggctacaaggacagatattaaaataatgactgagcccacatgtagaatataaatagtgagccaagaaagtgaagaaaggtcaaaaggcaaagtattcaggtcttccatctcagatgagaaaaggagagttaaaagtgagaaacaagacaagcagagttggaaaaactgaagactaattctgaagtgatatcatcaacatagctcatctgtgcatgacttgatatactttgctggaacaaggccataaccttcaagtagaaaagtcattcttttttttttttttttttttttttttgagacagagtctcgctctgttgcccaggctggagtgcagtggtgcgatctcggctcactgcaacctccgcctcccaggttcacaccattctcctgcctcagtctcccaagtagctgggactacaggcgcccaccaccgcgcctggctgattttttttttttttttttttttttttgtatttttagtagagacggggtttcattatgttagccaggatggtctggatctcctgacctcgtgatccgcccgcctcagcctcccaaagtgctgggattacaggcgtgagccaccgcgcccggccggaaaagtcattctaaatacagtacattatatccatctttgtaactattctgcagcctaacctagtgccaggaacatgtgatgtgaaaatgtgctgaattaacacttttgcaagtaatgattataacatacacgcatatattctatgtgtattcatctgacccagtaggcaaaacaaagctactggaaatactgaactgtagaataggatgttgatatggttcagctctgtgtccccacccaaatctcatatccaattgtaatccccgtgtgttgaaggaggggcctgatgggggggtgactgaatcatgggggcagacttccccgtgctgttctccttacagagttctcgcaagatattgttgtttgaaaatgtgtagcacgtcccccttcactctctcctgctctgctgttctcgtgatagttctcgcgagatcttgttatttgaaagtgtgtgacacgtcccccttcactctctcctgctctgctgttctcgtgatagagtcctcaagagatcttgttatttgaaagtggctcctgctctgctgttctcatgatagagttctcgcgagatcttatttaaaagtgtgtagcacgtccccattcactctctcctgctctgctgttctcctgacagagttctcgcgagatcttgttacttgagagtttgtggcacgtcccccttcactctcttgttctgctattctcgcaataagagttctcgtgagatcttgttatttgaaagtgcgtggcacgtcccccttcactctctcctgctctgtcatggtaagatttcccttctccttcgcttccagtttcctgagacctcccagccatgcttcctgtacagcctgcggaactgtgagtcaattaaactgcttttcttcataaattacccagtctcaggtagttttttacagcagtgtgagaacagactaatacaggtatcttatctgaaaccagtgacttgaaactactaactcatggcatacagtaaatatcaaaagactaatttattctaccacctataagtcacatacagtattaaagcctggaaccaaaatgtaaaacaatcaggagctttggaaataaactgtcacgtgaactgaagattcttctgtcatttggctgcagaggaaaccattccgccacccaaaaaaaaaaaaaaaaaaaaagccacaaagaaagaagcagggatgaaaaaacacaagataacacacttaggctcttgaagtcattccactttctagtttcattcccttcccaaatcacaagacacacccctacgcttgatttctgtgagataccctgaatccttttaatatattcttctttgcttcagctaacactggtttctatttcctgcaaacaaacaaatttcataccaaccataagtaccacagtgctttacctcgactgcctttattatatccaagaacttcattgtcaaaaacatctattccttttacaactctgatttcacttcttactcctcttctcaattaccaatttattcaaatatctactgagcacctgctctagcacttagtaacagaaagatgaatatgtcatggtctctgcactcaagcacagtctagtccagttttttcaagctgtggatcttgatcaatttgtaaaatcaatttacttgtcctgagaggaactttttaatatttgaaatataagaaaattaaaatactgcatcacaagaaattaaatattattttctacagcttttgtttcagttacatgtgtgtttttactgaatagcaatatagtatgtatatctcactgtgggtcatgaacaaaggatttgaaaaataccagtaggcccctatttcctaataatgtgaacaaatgccaaggaagaagtcagtcaaaagctgtgccttagaaaatcctttagtgttttaataaaaaataatttcaattggtgttttcctagtttatgttgatttcataagtacttgaaaacagttgttggtttgcctcaagtagattaaacattccgtcttgtttatagttttaattagctaaacaaatccttttctctttgccttgaacattacaaagaaacttcaattcagcatgtcagaattattataaactcctaattagctaagtacaaatttagtacatttttaccacacttacaatgaatgctgtctgggctaaataaaccccaatcatcataagagtatctatcagctacaaggctacaagccatgacaagttagcctgaagaaaagaccatgaggcagaagacagctgtgctcaaatattattaaaggcataaaatgactctaaattgtttaaggtaacttctgaaaaatgtaagttaaagagaatgtagcaatacatcaaataagcgttgggcatcttgtaggatttcttgtattaataatctgattttgtttcaaggaaaattaattcaagcatgtttattctctagtttaaaggctgtccatctttatcagatagtggaaattatctgaaattagtggaaattagtgggaaaaaaagtggaaattagtcaacaagaatatttcctaaatacctagtacatgtagctccaggtattatgcagaacactacatatttctggaaaagtcataaaatacttccaaattatatacatgttattatgttaaaatccatagtaaaaacttagaacaattttagtgccaaaaataatcacatcataaacatgtttctatagaaaaatagaaatcatataaagcacagcaatctatttccatgtgttttcaaaaacatatacttgctacttatctatttgttttgctagagagaattaggtaactaaaggctaagaaaaaatatgtaaaaaaaaaattaaaattgagggggctgaggcaggagaatggcatgaacccgggaggctgagcttgcagtgagccaagattgcgccactgcactccagcctgggcaacagaactggactctgtctcaaaaaaaaaaaaaaaaaaattaaaattgagaaaatgtattcgcaaactttgttttctcagacacaggaaaagtaccactattagctggttttcacagagccacacacttttggcatacctgtgttcacgtattcattctcatttattctaaattaattgattgtctgcctaattctagagacataaagatgaaggtactcacagtttagaaaaggaacaaacgtataaaccaaatgtaatttaatttgcaaagtgcaacacagagtagagtacctaatccaggctagtgtggtagggagggcaaggaaggcttccacaaaagaggtgaaatctaaaacaaaggataggaggcatccaggtgaaggtttggtttctgaacacttttacgtgtgtggaggtgtggaaagcctagcattgtgagtacgggcatggcaagaagaattcgcctgctgggtacagtgcatcctcccgcggggcctgctgggtacagtgcatcctcccgcggggcctgctgggtacagtgcatcctcccgcggggcctgctgggtacagtgcatcctctcgcggggcctgctgggtatagtgaattctcccgtggatgctgcaggaccccatgcctagaggtctggagaactgtgctccacagtgatcagcggtacccccatccttggacctgcctctcccacgactccatgggggcctggcctcaagtcataggcccccgactgtgccactgtgtccactggtaattgtacacctgagcaatggaagggtcacacagaccccaccacccacaaaactgcatgtcagatcaccccatctctgggcgcatcccttgaccccgaggctcggagggcagaagaatcaccatcaggccatctggtatagctgaaacaaactcagcctggagctgagagaagggtcagaactggagggctacacaaacacactaaggattttggattttatgttgtaagaaatcaggattcagagaaatcttagatagctcactctatgagctaacaaaaaacagattagtaaataagaaatgagaattaagaaacattttaggtcgaaatgagatacatactatacaatttgctggtaaacaaagcaacaaaatacattttaattgagtagaaaaaaagaaagaaaaaaatggtaggggacagcaaaatcacatctaagaggctgtggcagggatgacatccaggtgagaaactgggggcctgaactgtgtagtaggcatggaaaggagaatgcaagaaaaacttggtgatataggaaggaaaatgaaatgaacttgctgaatgactgcaatgagattgagaaaaggaaaaagtcaaggagtggttcaagatgaggcagggagggacacataggcatgctaacaatctgaagccctgaaccgagaacagtagctaggagggtaggaggggaacaagaatgaataccaggtgacgaatcaggagactaagatagaaatttaggcaagaggttatggtatgatggtttcaactaggatgatgatagcagagatacagggatatatgtatatttgagaaacattctactgctgaaatcaacaggattgcagttattaggctaacaggtcagggagagggagagaggatgtcacaaggacaaaacagtggggtactagttactgaaataaggaaggtaggagagaagcaaatttaagaatgaagattgagaatactgttttaaacatgtggaatttccagctcctctgagatatctaagttgaaatatcaactagacagttaaatacaagagtgtggggccaggcacggtggctcacgcctgtaatcccaacactttgggaggccgaggcgggcggatcacgaggtcaggagatggagaccatcgtggctaacacggtgaaaccccatctctactaaaaatacaaaaaaaaaaaaaaaaaaaaaaacattagctgggtgttgtggcgggcgcctgtagtcccagctactcgggaagctgaggcaggagaatggcgtgaacccaggaggcggagtttgcagtgagccgagatcgcaccactgcactccagcctgggagacggcgagaccccgtctcaaaaaaaaaaaaaaaaaaaaaagagtgtggaattaaaagaaaggtctgtttagactgaaatataatttcaagaataacaattatataagtaattgcaactctgtaagacaacagaggaggcatatggacggaaaagatggcccagaaacaggtctaaaatctacactttagatgccaggcgaggatgagcctgcaaaggaagctggagtctctgtttattaacaaaggttttgagaaatttggttatgaagaagagatggtacagtagccttaagaagtgtaaggcaaacggagagggtgctctttgttttctttttgaggaaagacaatatagcatgtttaagagctgatgggaatgtgtcagtagagagagaaaaaggtttaaagatacacaagaaaaggcctggtgcagtggctcactcctgtagacccagcactttgggaggccgaggtgggcaaatcacttgagctcaggagttcaagaccaacctaggcaccatggcaaaaccccatctctactaaaaatttaaaaacttagccaggagtggtggcatgtgcctatgatcccagctactcgggaggctgaggtgggaggctcacttcagcccaggaggcggaggttgcagtgagccatgactgctccactgcactccagcctgggtgacagagacagaccctgtctcaaaaaaaggtatacaagaaagacagaaaatattcaatagcataagtttccaagaaggccaaaatacacgggatccaggacccatgtgaagggtttagcccctcctctccacgatggtgtctaggtaaactgtttgtgtgtctgtaggacagtggttgaggaaacactcttggagccacacagcatcctctaaattctcagttttctggctcactgtgttaagattagtctggacttatcaataaattgttagccactaaagtacaactggttctgtgtagtctttttttcccccatggatctgttaatgtttatttattagtactagcatcttcctttgttctctgtgttaaagcaaagaaagaagagggttttgtcatataatctgattttagcttgacttgggaaacttgagattgtcatttaatatatcttcttgctttaagaaataaattccttgtgtttacaattaattgatcacaaccagctatggatttctttgttccttcgccactcccactgctttacttgacaagaaaaaaagaaacaaagaaattccttgaaaatgaggaatacaaactgcagggataaaatataaatcaaacaaaagcatctcagctaaacctctttttttgttttccagatgctactatccttcaagatggtaattaataaaagagagaaaaatgcctaaacaccaactgatgttttcttgtcaaatctgtttcatcagacccaagggatatggcaggagatggtattctacaaaataattcggattctctttctaaagacttgaattgtttcaggaaaaataaacgaattcacaaatcagtaataatgcacttgtaggactaactatgagctgccatcactctgtaaatgaataaaacatagcggcatctacttctaaaactagtgccaaatacaccactaataactcctcgatgatgcagggaatcagtgctggtaattaacataaattaatgaaggaagttgaaaagttcagaagaagtattaaaagaacacctatcggggcggggcacggtggctcatgcctgtaatcccaacactttgggaggctgaggcaggaattgcttgtgcccaggagtaccagaccagcaccagcctggggaatatagtgagaccatatgtctacaaaaaaattaaaaatcatctggattattaaaaaataaataaataaaaaacagatgctggtaaggctgtggagaaaagagaacacttaaacacttgttttttgtttttcatttttttgaaacagagtctcactttgttgcccaagctggagtgcagtggcacaatctcagctcactgcaaccttgcctcctgggttcaagcaattctcgtgcgcctgcctactgagtagctgggattacaggcaagcaccacaacacctggctaatttttgtatttttagtagagatggggttttgccactttagccaggttggtctcaaactcctggcctcgtgtgatccacctgccttggcctcccaaagtgctgggattagaggcgtgagccactgctcctggccacttatacactgttggtgggaatgtaaattagttcaaccattgtggaaaacagtgtggtgattcctcaaagacctaaaaacagaactatcatttgaccagcaatcccattacttggtatatgcccaagagaatataaatcattctaacctaaagacacatgcacatgtatatttactgcagcactattcacaatagcaaaagctgaaatgcccatcaatggtagaatgcataaagaaaatgtacctatacaccatggaatactatgcatgcggccataaaaagaacaaaatcatgtcctcagcaggaacatggatggagctggaggccatcatccttagcaaactaacacaggaaaagaaaaccaaatactgcaggttcttgcttaaagggggagctaaatgatgagaacacatggacacataaagagggacaacagacactggggcctccttgagggtggaggttggaaggagggagaggatcaggaaatataactgttggatactagacttaatatgtggatgacaaaataatctatacaacaaacccacatcacatgagtttacctatataaaaaacctgcacacgtatccctgaacctaaaataaaaattttaaaactaaaaatgagctgggcatggtggcacatgcctatagccccagctactcaggaggctgatgggggaggatcacttgagcccgggaaatcaaggctccagtgagccatgatcatgccactgcactccagcctgggcaacagagtgaggccctgtctcaaaaagaataataatttttaaaattttttttttaaaaatgctgggcgcagtggctcacgcctgtaatcccagcactttgggaggccaaggcaggtggatcacttgaggtcaggagttcaaaatcagtctggccatcatggcaaaacctcatctctactaaaaagacaaaaaaattagccgggaatgggggcgtgtgcctgtaatcgcagctacttaggaggctgaggtaggagaatcacttgagcccaggaggtggaggttggagtgggctgagatcacatcactgcactccagccttggcgacagagtgagactccatctcaaaaaaaataaataaataaaatttaaaaataaaatacacttaccaataaaacaatggcaagttgctgtgactctattacttaggacaggagagacacatcatttgacagaattagatttcacatactttaggatgctacctgttttgcttgaactacccaacataaatataagggaaataataaaaatataagagcagaaataaatgaaatggaggctagaaaaacaatacaaaagatcaatgaaacaaagagctggttttttaaaaaacacaaaattgacaaacctttagctagacaaaaagagggaagactcgaataaagaaaatcagagatggaaaaggagctattacaatggaaatactaaggatcgtaatattatgaacaactataggtcaaccaactcaataacataaaaaaagagataaattcctaacacatacaatccaagataaaagtctcccatcaaagcaaagcccaggacctgacagcttcactgctgaactctaaaaagcaattaaagaactagtactaattcttctcaaactattccaaaaaatggaagaggagggaatacttccaaactcattcaaaaaagccagcattattctgacagcaaaaccagacagacacaataaaagaagaaaattacagacaaatatccctgattaacatagaggcaaaaatcctcaacaaaatatttgtaaaccaaattcagcagcacatcaaaaagagcactcaccagtacttgcagaggccaaggtgggcagatcgcttgagcccaggagttcacgaccagcctgggcaacatggcgaaaccccgtttctactaaaattacaaaaattaggcgggcgtggtggcacatgcctgtagtcccaactactcagaaggctgggttgggaggatcacttaagcccaggaggtggaagttgcagtgagccatgatctcaccactgcactccagcctgggcaacagaacaagactctgtcttaaaaaaaaaaaaaaaagataattcaccatgatggagtgggattcatcccagggacgcaaagatggtttaacataagtaaatcagtaaacatgatacatcacattaacagaatgaaaaacaaaaaatatatgatcatttctatagatgcagaaaaaggcatttgacaaaattcaatatgcctttttaaaaacatttacagttcagacatggtagctcacatctgtaatcccagaactctgggaggttgaggcgggcaaatcgcttgggctcaggagttcaagaccagcctgggcaacatggtgaaaccccatctccacaaaatatacaaaaattagccaggtatggtggcacatgcctgtaatcccagctacttgacaggctgaggcaggagaatcacttgaacccaggaggcagaggttgcagtgggccaagatcacaccactgcactccagcctgggtgacagagtgagactctgtctccaaaaaaaggaaaaaaaattaataacaataataataacaaataaaaattaacagggctgggtgtggtggctcatgtctgtaattcaacattttgggaggctgaggtggaagggttgcttggggtcaggagtttaagaccagactagacaacaaagcaagacattaccactggaaaaactttaaaaattagccgggcatggtggtacatgcctggagtcctaggtacttaggaggctaaggcaggaggatcacctaagccaaggagttggaggctacagtgaactatgatcataccactgtactccagcctggccaacaagactgtgccttcagtcattaagcctctgtacatggtagccttttcacgctaaacccaggctactgcctacccactggcccattcagtacctccacattccatcactagagcaaaagagaacttctggatccccagcatgacaagcacatgccatgaagaactcagagttgccatatgtggccagtctccttggccactcactggagaggcctctctgctgttagccacctgctttccacaatcactctcatctatctgacacacctcccaaacagaggaggtctcaccaacgacttcttcaatcttggtcttcttccattccacaattccccttggccgaaaaaggcccaaacttattataaatcttactacctagcagtcaaggcatggtgttaatatgtcaacaaaagctaaagggattttttaaatggctgaaaccaggctgagaaggcaaagtacaacataagcctggaacattttgttggactggaacattttgtcattccagagagtaagaaagtgttcctaaaaattatggaggtagatcaaatacagaagccagcttgaaggggctcccatgagtcaaatcagtgacaatttcagcatcaaaataaataagaacaataatggaacaaataggaaccaatggaacaaataggaacccatgagtccatactaataataaatagatacataaataaatagaggagaaggtaaggctcctccttagaagaaaataaagacataaatgtggagggaaccataaataatgattcaggtaagaaccaatcaataatagatgttaactctatggaggaaaaaaaactgacgaggaatagacatttgcatggtctcaaagtgtctccccacagactggctcattagttacaaggggaaaaacagtaactactcacccaaggctgtatcttaaccaagtgattaaaacttcaccaactaggagcagatggacattgtgtgcttcctggtgtgatatcctcagaacaacacagtatcacacatacactacataaatactgtcttatgtaatactctggctggggttgaaaaattcaagtctaatcatgagaaaacatcagacaaatctaattcggtttttttattctataaaataactgacttgcattcttcaaaaatattaatatcataaaagatgagaaaaggctgaggaactactccagattaatggagactaaagagacatgacaactacatgtattaatatataatccagctggacacagtggctcatgcctgtaatcccagcactttgggaggtcgaggcgggaggatcacctgaggtcaggagttcgagactagcctggtcatcatggcaaaaccctgtctctgctaaaaatacaaaaaataattagctgggtgtagtggcacacacgtgtaatcccagctactcaggaggccgaggcaggagaatcgcttgaacgtggaaggcggaggttgcagtgcccaagatcacaccactgcattccagcctaggagacagagcaagaatctgtctaaaaataaaaaaaaattaaaaaaaaaaatatatatatatataatatatacacatacatacactatatatacacactatatatatacacacacactatacattgtgtatatatacacacactatatatatacacactatatatatagtgtatgtatgtgtatatatacagtgcatatgtgtgtatatatatagtgcatatgtatgtgcatatatatatacatacacacaaaaaaaatcctacactggatcttggactaaaggaaaaaaatgcaacaaaggacattattgcaacatcgacaaaattggaaaaatgaactagagatcaaaagtactgtgtgaatgttaagtattttggatttgactaagtgtagaatggttatataagagaatatccttgttcttaggaaatgtacactaaagtggtaaggaaagagacattaggtatgcagcctaccctcaaatagttaagaaaaataaataatatttatgtatgtgtgttgtgtgtggggggtggtgtgtatagagaggaaataaataaatatgataaagccaatagagcaaatgttaaaatttgtttacttagataaaaggcatgtaagggttgtctgtactattcttccaacttttctgtaattttaaaattattccaaaataaagctttttaaaagcagtttgaccaattttaaaagatgttttaatttttttaatttttatttatttttttagagatggggtcttgctgtcccccaggctgaagtgcggctgtatgatcatggctcactgcagcctccaactcctgggctcaagtgatcctcctgcctaagcctcctaagtagcagggactacaggcacatgccactactcccagttaattctgtttttttgtagagacagggtcttgccatgttgcccagcctggtctcaaaatcctggcctcaactgattccccatccttggcctcccaaagtgctgggattacaggtgtgagccaccatgcctggccccatattttaaaataagactgcattaacctgtcatctttaatttcaaccatataagcaaggtaacaaaataaactttccagtgaagaagatctaaaaattaatgtgatataaagcatagataaacattttatgagaggattaaaacttcaactagcacagcaattatgcactggcgctctgcttactgttccactcggatttcattttgggctcatcagggatcccctgagtaagattaaaacactttatatcttatctataaatagatcattacatttgcatagaaagaagtttgataaaaatgtagaaagactacttcttaagttaactaggctaaaaactatgcaggtaccaaatttggctcctaatctcagtggcttttaaaagctaattagcaggaagcacaacccaaatatagaaagtgaagacaatcagtccaatcttggggaacaaaaacctaaagtaggtgttacttgtgatgtattatgctctgaataagtccattaaaagcatgtaagcattcaaccaaaatatttgattttaatttttcaatgattccagatgttctttaagttgaaaaaaaacaaaaaaaaggaaaaatgaaaaccaaaggttaaataggcaacactccagcacaagccacaaggggcctcagaaaaacacacacaccacactcctacaaatccacccgcctagcacccatacagaacgtgccataggtaattatgatcatcagaggcttttgatcttgtggaagaagaaaaaaaagaaaacagaaaagtgacaggcagccctttttgcaatttaatgagtggaatatgcttctacaatagctggaagcaccttttactatgttgttttttgttgtcattgtttttcgctatacctgctagattagaattttattttgtttttaaatttttaatcaaagcaatatataccatatggttaaaatggcaaataggctgggcatagtggctcatgactgtagccccagcactttgggaggccaagacgggcagatcagttgggcacaggagtttgagaccagcctaggcaacagagtgagaccctgtccctacaaaaaacagaaaaacttagctgggcatgctggcatgcgcctgtagtcccagctactggggaggctgataggggaggatcgcttaatctcgggaggtcaaggctaccccgagccatgatcacactactgcactccagcctgggtgacagagcaagatcctgtctccaaaaaaaagtcaaacagaaaaaacaaaaagcttccttctcctgctccccaaggcaatcatatctaactatttcatttcagggagtctcccgcagttactctcaaatttcttttttttttttttttttttttgagacagagtctcactctgtcactgaagctggactgcagtggagcaatctcagctcactgcaacctgtgcctcccgggttcaagtgattctcctgctcagcctcccaagtagctgggattacaggcacatgccaccacacccagctgatttttgtatttttagtagagactgggtttcaccatgttggccaggctagtcttgaactcctgacctcaggtgatccacctgcctcggcctcccaaagtgctgggattacaggcatgagtcactgcacccggcctaatgaatctttttcattccctcatttggtaggtatcttaatgttttagtttatctttttacatggcttaggttctggcaatacgagaaactattaagttaactggttctacatcttggagataaatagcacttcagcagtttgagttcagaatatatttagagtaaacctgatttattatgttattattcattttatgttatatattttgaaattcaaaaaaaatgccttgattccttattacttttgctaagtattctgctcatctcagagaagaaagtgtttttggactagctctgtaaattaccactctaggcttgtttcagaaccatttttctaaaaacattattttataaggtcagttgcttctagctaggaatattactgattttctaataggccttgttgggtttcaaaaacactttttaatgtgctaaaattgccccccaccaccatagcagacagacaactacccagctatgcactggtgatctaaaagccatttatgacatattgttattattatgacttactgttattacagtataagagaagaggcggaacacatatgcctcaatcccttcagagtttgttttttggggcgagggggtaccactcctccatgacttaagttttaaagaggtatgctctgcccctcaggggaaagcctgcaggtgtacttgtccagcattcccatgagaccaaatgaggtttgtctttgttgccaaattttgcagcagccgattgttgccatctacccaagccacttttcaaatgctccatcactaataaagctgaaattgtaattttcaaaagataacaaaaaaatctgctaggccatttaaattcaccatacataatacctaccaaaagttattaacaatttatttttaatctaatcctataacatgcttactaatagttaacatctaaataaattaattggaacaggattcaaaatgttctaattctacatcggagtgttttcagcttttacctaaactttgaagtctgtagtcttatccctcacagataagacaggcattcagttttaaacagttcttatagaaatttagaagtgggccgggcgcggtggctcatgcctttaatgcaagcactttgcggggccaaggcgggtggatcatgagatcaggagatcgagaccatcctggctaacacggtgaaatcctgtctctaccaaaaatacaaaaaattagctgggcgtggtggcacgtgcctatagtcccagctactcaggaggctgaggcaggagaatcgcttgaacccgggaggcagaagttgcagtgggccaagattgagccactgcactccaacctggacaacagggcaagactcccctctcaaaaaaaaaaaaaaaaaaaaaagaaatgcaggagtaatgaggtttcactacttgtttttaaactgacactaaacaattattaacatcaaataaattctatgtatagaaatacaaaatataaggattgagtttttaatctctactatatataaaataggactctaacaattactgcagaggtcagcaactccaaggtttatggaaggaaaaggggagacaggagacagagggcgtggtattgtctgcaggtcattctctggctttctttccagtatctccctttctccttccctcccactttccaagaagttgctactgtatgaggaaattctgtcaagtagcaggaaggggaaggctttgagccttgtagctaggactggtaagaactaagaaaattggtcctatctgtgctatcagattaaggagggtgtcgcctctggtacttttggcaaagatggtcaaatccccaactacaacctcacagtgatttgtggcgcattaaaaagtttgtacttggtcgggcgcggtggctcacatctgtaatcccagcactttgagatgctgaggtaggtggatcacctgtggccaggagttcgtgaccaccctgaccaacatggcaaaaccccatccctatcaaacccctgtcgactaaaacacaaaaaattagccaggcatggtggcaggcgcctgtaatcccagctacttgggagactgagggagaactgcttgaacccggaagaggaggttgcagtgagccgagagcccaccactgcattccagcctgggcaacacagcgagagactgtctcagaaaaaaaaaaaaaaaaaagtttgtactttttggccggcagccatggctcacacctgtaatcacagcactttgggaggctgaggtaggtggatcatttgaggtcgggaattcgagaccagcctggccaacatggtgaaacaccacctctactaaaaatacaaaaaaaaatagccgggcatgatggcgcgtgcctgtagtcccagctactcgggaaactgaggcaagaggatcgcttgaaccagggaggcagaggttgcattgagtcgagatcacaccactgcactccagcctgagcgacagagcaagactctgtctcattgtattgcccagagtggagaccagtggcacaatctcggctcactgcaacctccacctcctaggctcaagcaatcctcccgcctcagcctcccgagtagctgagactacaggcatgcaccaacacaccaggctaatttttcatatttttggtagagacagggtttcaccattagctcaggctgatctcaaactcctgagctcaagcaattcacccaccctggccaccaaaagtgctagtattacaggcgtgagccaccacgtccagccaagtttttactttgaagcaatagctaaaatagattttattcacactcaaagcaaaggttataagctatctagattttgttattctatgacaggtaatatagaaatacagttcagaaagataatgacagtatatgatcctaaagctatttttctttcactttaccaacaaattgtaatgttcattctaatgaatatggacattttattctataattacacatcaaagtatacagtgtactctatattttaaaaatatctaggtaattctaatggagtacttcctacgaactcctctaaacattgcaaacgtaccatcatcgtcactgttttacagttaaggaaactgagatgcagaggttaaattacttgcccaatgtcacaaagttagtaagtctcagattcaggatttaaactggctccacgggccagtccaatccacgcctctatgcctctcgggctttaataggcatgcacatcacctggagatcttgttaaaatgtagattctgagttaagttggtctaagactgggcctgagattttacatttccaaaatcatttagttacactgatgctgctggtccacagactgtattttaagtaacaagactgtaaaccactttgccctgctacccaactaagcatcaagaaaggggtgatatttaactcagatcctaacaatctaagcaaagaggcaattatatctgcaattcaaatacagaaccaaggggctgctttcaacctatatgaagactttcaatttacaataaaattcaagacccaactaaaaagaacttgatttgttcaatgtccttatttttctagtctaaggacaaaagcctatttcttcctgtccccatacaaacacagagaagaaaacaactttttcttttttgcagacaagcttttccagttggcatttgactaaaaattacatgtaaaaacaaatacatcaagtaagacacaaaactcttgactattcaattatcaaatacgtcacaaaaacctgtaaaagacagcttgtctctggaacactctagctcagcaactttttaaaggagggattagagaaagaaattgttccaactagtcatgcttctctattgaaaacaacatgattcagacctgacatttaaagacatctctgatgtgaattgaaaccaattttcttctttcaatctagaccaaaattaaaatgtttaattcctattaaacttaaacctcatttctctttctcaaattcaagctatttctaaaaactttcttgcacactcccttttaaggactattcagagttttctttgtgtatgcatcctattttcccaccttataagatacttagataaatataatcaatgaatttgttaggttttaaaattaacatttagtcttactgatacctaattactataatagctttctccaacgggtaccatgatgtcagaaaaaaacacacatacatactaaaatcatctcttaacacgactatattctaacactgtttttgaaaacctagagaaactacctgagacaagtttagaagggaaatatcatttatagcacacctacctgaaagtaggtgcaggctttgcaattaggcagacctgggtttacattcacctttagtgactgtgtgacctacgggcagatttatctaaacttactatgtcatagttctttgttttacatgtagtaaattcaattacatagttacagcaatagatattatagaaccatttttataaaagggaaaattaaagctcatggaatttacacaacttattgaatcacctagtaactggaaaaatcagaatttgagtccagctctatcagactccaatgcccagggcttctcctgtgagccatatacggcctgtggagttactgactgcttaactgaggtaacaagtatttcccacactctcagaatgaatctgtaatttaaagaagcctataactctactgcagcacaaaagccacctgcgtctacactactggtactaagacaaccaactattaaatatcaactagctaggaaataaacataaaagtcagtctcagctaacccaagaaatattaatacatatgtagataagggcaaagatgactgagagaatttgcttctaaggtcctcccagtcttcatactaacaaacatctgttgaggacctactgagaacatatgtggctaggtacccagttacattttacctaacattatgacacgatcaagactaaagaccaaaacaatttaaaaaaattaactaacctaacctaaaccacaataagagtttctacaactgatgctttaaatgataggagatttcactgcatctttggacagtcacctaaaagtagaagtaaatactaaggatactctgtgtaacagagtcaggaggtgagaaagcactggtctatgcacacataagtgctcatatatgcacacctgtcctctgtcctggagctggtacataagtgctcatatatgcacacctgtcctctgtcctggagctggtacataagtgctcatatatgcacacctgtcctctgtcctggagctggtacataggtgctcatatatgcacacctgtcctctgtcctggagctggtacataagtgctcatatatgcacacctgtcctctgtcctggagctggtacataagtgctcatatatgcacacctgtcctctgtcctggagctggtacgtaagtgctcatatatgtacatctgtcctccgtcctggagctggtacgtaagtgctcatatatgcacacctgtcctccgtcctggagctggtacgtaagtgctcatatatgcacacctgtcctccatctggagctggtacgtaagtgctcatatatgtacacctgtcctccgtcctggagctggtacataagtgctcatatatgcacacctgtcctccgtcctggagctggtacataagtgctcatatatgcacacctgtcctccgtcctggagctggtacataagtgctcgtatatgtacacctgtcctccgtcctggagctggtacataagtgctcatatatgcacacctgtcctctgtcctggagctgatacataagtgctcatatatgtacacctgtcctctgtcctggagctgatacataagtgctcatatatgcacacctgtcctctgtcctggagctggtacataagtgctcatatatgtacacctgtcctctgtcctggagctggtacacaagtgctcatatatgtaaacctgtcctctgtcccggagctagtgcattaagtgctcatatagttacacctgtcctctgtcctggagctggtacaagatcatggttcatactccaggaatgagggctagaagacctggttccagatccagctctgtcactcacagctgtgtgacctgggtcaagtaacctctttaagcctcagtcactttaactgccaaatgagtataaaaatagcacttaatttacgaggttgttcatttaatacacttttgttgagattacatcttgccactggcatcctgctaggcattgtggattaggtgttaaaatgcacgtgatgtgtttggcatgtgtcaaaaagcgggatttttttttttttttttttttttgagacagggtcttgctctgccacccacgctggagtgcagtggcgcaatctcagctcattgcaacctctgcctcctagactcaagtgatcctcccacctcagcctcccaagtagctggaactacaggtgtgtgccaccacactcagctagtttttaaaatttttgtagagccaaggtctcaatatattgcccaggctggtcgtgaactcctgggctcaagcaatcctcccacctcagcctcccaaaatgctaggattacaggcttgagtcacggcacccagcccagagcagggatttttgtctgttgtggttctctgctgtatcttcagtaccaacaacagtggctggcacgtaaagtctcacattaaatatctgctgtatcttcagtaccaacaacagtggcatgtaaagtctcacattaaatatcgcaacaaatactgaaaaaattgtttagcatcaggtgggtcagaaactactcccccgacccttgtttggattcagcctgtgtatttttaggtatcactaaaagaagttcaaggatctttttttaatttctttttagtttttataacagcttcatagagctataatttgcaaacaataaaagtaacccacttaaagtgtacaatgcaaccattttacattcacagagttgtgtctgccttgttttaaagacagggtctcacaccatgttgaccatcctggcctcaagtgatcctcctgccttggcctcccaaagcgttgggattacaggagtgagccaacacacccaggctctttcattttaaaaagagaagtcgggctcctgagactccatgtgtgagtttctgtcacacgtatttaaagtacttttaattgaacattttctgtaacaaaacactaaaacatacaaagaagtaaagcataatgcactctcatgtactcatcaaccaatttccataattatcaacttttttttactatattaaaatgtttcaaataccttagaaggttagattaacaaacacctctctattcagacacatctagttcctattccgagagaaaggggaaaagatataactacattatctgacacaacggtggctcttacgtctgctcccttacaaaatgtcactgtacagcaaaaataatttttaccagcaatgagtatccatagaaaacatagtaatcaatcccccattcccttccactatgctattttgggtccttctgacaaaatgaaagtaaatctcaatgcaattatccaagttaccttttttcaaaagatcttttttttttcttttttgagacagagtcttgctctgtcacccaggctgaatggagtacagtggtgcaatctcggctcactgcaacctcagcctcccaggttcaagcgattctcctgcctcagcctctcaagcagctgggattacaggcgtgtgccaccacacccagctaattttttgtatttttagtagagacagggtatcacaatattggccaggctgatctcaaactcctggcctcaagtgatccgtccaccttggcttcccaaagtgctgggattacagccactgtgcccatccaaaagatctctttagatctcaagttctataataactaacagagaaagagcaatacacatagactatagatgtaattaatctgttccaaataccttcaatatgccatcttccttctgcagatctgtaatggttgatttcacatgtaaacatgactgggccacaagatgcccagatatgtggttaaacattattttttggtgtgtctatgagggtttttctggaaaaaaaaatagcatttgaattggtgaactgaggaaagcagattgcccttttaaatgttagtagatatcatccaacctgtgagggcccaattagaacaaaagaatggagaaagggtgaattctctctctctctctctgattacttgagctgagacatcagtcttctcttgctcttggactgagacctaaaccatcaatcctcctggttctcaggccattggactccactttcctgggtctctaacttgcagagaacggatcatgggacttctcaggctccatatatatatatatacacatacatatatacatacatacatacacatattcatatatgatcatatatataattatatatataaactcatatatgagtatatatgatcatatatgattatatatatatgaactgatatgagtatatatatgatcatatatgattatgtgtatccatagaagatatatatatatagagagagagagatcgatcgatcgatcaatactctactggtttctctggagaaccttaatacaggggttcaaaaaaattccataacttctggctgggtgtaatggctcacacttgcaatcccagcactttgggaggccaaagcaggaggatcactcgagtcctggagttcaagaccagcctgggcaacataatgagaccctttctctactaaaaataaacaaaattagccaggaatggtggtgtacacctgtagtcccagctactgggaaggctaaggtaggagggtcatttaagcccaggaggtcaagcctgcagtgagccatgatcatgccactgtacaccagcctgggcaacagagcgagaccctgtctcagaagcaaaaaaaaattccgtaacttctaacatcaaagtgatcctcagtttgccatgagaggtaaaatggtgggtcagcccagggcatataatctttacactaatggttatcacctaagggcaacatgcagaaagccacagcagtgctccttagtgataggatcctcaatgttatagatacatcctcaatgttacagatggtggtacttcttacccccatataaattgatttatcatgtgtctacatctatcacatacataagcatcatgtggcacaaagtggtattaccccagattttttttttccacagttacaatggttgacgaaagccactctgtcgcctttcctggcctacgtcagggccaagttcaaaccctctccctaactgcagattagcagtcatggtgggctctccacagctctcactcagaggtgccagtacacctccctgcacatacagcgggataaacagctaggcaatctcagtcaagtgctttcttctaaagaagggccagcccctgaactaaaagacatataattttggccaataaaactaaggtaacaagttccatatgttttataaacataagatacgataaaaaacacaaagtgctccagtttcagatacagggaaatcaaggccatatacttctcagtaggggaaacgtccaacaagatcctgggaaaccagcagttggggatagaaagaggcaaacactgctccacagacaagggcagaccaaggagcctctgattccccagagtctacagttatatgcagatctctcaaggggatgaaactagttaacccaaatttcaggtttcttctgacttagaccatatgtccttacagcaccaggttgagctcattgcccctctcttgaacctaaacaaagcccagctgcagacttagaaaggatttactgttcataacaacaaaactaattttctactgtacccagacgatctcctctaaaaatgttcctttttaagtgaccaagttaaaggtaaaggatgacttccccctcgatgatatgtatatttcaattgatgtgcctgaacattaagagttaagctgttgataagtccttgaaatcaggcattctcataaaacattcacattaattcaagcaaaacattaaagagcattacataatgagtcatactaaaatggcaatgaaaagaacaaccattaagacacccagagtatcagtttagctccagttatcatttatagcatgaaaacatgtcttgagactaacatcaaaacacttacctcagcccccagaagtatcctgttcttccccttaaatacacaacatttaccaaaagcactgttttacgcaaatacaaaaggctaatctaaaaatgaaactaaaaaaacttatttggaagaatattcactaagctatctctattgcagatgtaaagccttaaaggaccatttaagggaaagggaaggctgtataattatgtaataatgttctctgatacaattgtggctctcacataagctttcttaaaagagaagagctatgaacaattaagatggcatagcacaggaaaaaaaaatgaccagcaatgagcattcacattctttctcctctctcatcctctctgctttttgggacctttccaataaaaggagagcaaatctaaatacaatccaagtcattttgtggttaattccaaataatgttccatattttaataaatctaccattgctttttcacaattgtaacagatgccactcccaactccttagatgtgaaacctaaaaacatatcacttcaaccaaaatacctaaactattgtactagttacacctaaaaacacatcacttcaaccaaaatacctaaaccattgcactagttacacctaaaaacacatcacttcaaccaaaatacctaaaccattgtactagttacacctaaaaacacatcacttcaaccaaaatacctaaaccattgcactagttacacctaaaaacacatcacttcaaccaaaatacctaaaccattgcactagttacacctaaaaacacatcacttcaaccaaaatacctaaaccactgcactagttacacctaaaaacacatcacttcaaccaaaatacctaaaccactgcactagttacacctaaaaacacatcacttcaaccaaaatacctaaaccactgcactagttacacctgaaaacacatcacttcaaccaaaatacctaaaccactgcactagttacacctgaaaacacatcacttcaaccaaaatacctaaaccattgcactagttacacctgaaaacacatcacttcaaccaaaatacctaaaccattgcactagttacacctgaaaacacatcacttcaaccaaaatacctaaaccattgcactagttacacctgaaaacacatcacttcaaccaaaatacctaaaccattgcactagttacacctgaaaacacatcacttcaaccaaaatacctaaaccattgcactagttacacctaaaaacacatcacttcaaccaaaatacctaaaccattgcactagttacacctaaaaacacatcacttcaaccaaaatacctaaaccattgcactagttacacctgaaaacacatcacttcaaccaaaatacctaaaccattgtactagttacacctgaaaacacatcacttcaaccaaaatacctaaactactgcactagttacacctgaaaacacatcacttcaaccaaaatacctaaactactgcactagttacacctgaaaacacatcgcctcaaccaaaatacctaaactactgcactagttacacctgaaaacacatcgcctcaaccaaaatacctaaactactgcactagttacacctgaaaacacatcgcctcaaccaaaatacctaaactactgcactagttacacctgaaaacacatcgcctcaaccaaaatacctaaactactgcactagttacacctgaaaacacatgacttcaaccaaaatacctaaactattgcactagttacacctgaaaagacatcacctcaaccaaaatacctaaactattgcactagttacacctgaaaacacatcacttcaaccaaaatacctaaactactgcactagttacacctgaaaacatatcacttcaaccaaaatacctaaactattgcactagttacacactaccagagttttatagataaaatcctgtctgtacatttttccaatttccaagataaatatcattttattatgaactcacagcatcacagaatgtataattactgttgacatgtgaaaagtttccaacaggaatgaaaagcttcattaataataaagatctagccagatgcggcggctcacacttataattccaacactttgggaggctgatgcaagaggatcacttgaggccaggtgttcaagcccagcctgggcaatacagtgagacccccccccacatctctacaaaaaaaattttttttaaatagctgggggtggtggttcgtgcctgtagtcccagctatttgggctgaggtggaaagattgcttgagcccaggagtccaaagctgtagtgggctaggatcacaccactgcagtccagcctgggcaacagagcaacactctgtctcaaaataataataaaaataataataaagatcatgggctctgagtgcagacagaattagctacataatttgagcaagatataacttctctgaacttcacttttcttatctgtaaaacaggaataatataaagagagacctcagaagattttgcaagactaaatgagataatgcacactaaagcccatggactcattcctgacagaaagcaagtattccttaagtgttgaccatcatcctcctctatactgagtaaaatgtatcattactgcttacttatcagtcacatataatatcccaggctttacgctggatgctgaacactttatcatagattatctcatttgttcttttaactaatcttataaggttgtttttattattgttgttaaccccattttaccaatgggaaaactaaggtttagctagtcagtttgcaggttcatgaaattagtaaacggcatcatcagaacctggaccagaatctatctgacaacaaagctccttaacagatatgacataagtattaacaggttcaaattcctctagaatgggtaataatagaagattccatacccaagtataggtgatattcatctaataactacctgaacttctgaccttttaggccaaaagtgaaaaattgaaaccccactccaattcttgaattgatatttaatctctaaaatatttatttcagggataagtgtgaagattataatacctcacatttatataatgctctggattaagtcatttgctcttcactaaaatcctatgacacagataggaattataaccccatttcattcattctgtagatgaagaaaatgaaaatcaaagagattaagtgatttgcccaaggtcacaaatctagcaaatggaagcagcgctcaaacctaagacttacttctccaagtacagtcctatttttcagtataccatgtagacaaacagatgaataatactaattaaaaagtgatcttcaaaaaaagtaatctcaccacccccaaaaaaactaattcactcatcatactcattctcattgatgatcaaagcaatggtatagttctccaatatacaacatttaaagaaaggagataagacttagaggagcataacactgttcaaaaaggtaggcccatggacatataaggaaagcaaaagatccactggtctccaagacaacaaaataaataaaattacccacctatactaatagaaaatatggtctagaactatactgaagaattttgtttaaataagaacagtcagaatgggtagacattgacggtacaagacacaatacctgcatccaagagcttccagaggaggtaaaaaaagtatttaataattactggttcaaatagttgaaatatggttgggcatggtagctcacgcctgtaatcccagcactctgggaggccaagcgagtggatcacttgaagccaggagtttgaaaccagcctggccaatatagccaaaccccatctctacttaaaatacaaaaattagccaggcatggtggtgcgcacctgtaatcccagctactcgtcccagctactcaggaggctaaggcaagagaatcacttgaacccaggaggtggaggttgcagtgagccgagattgcaccactgcactccagcctgggcaacagagcaagactctgtctggaaaaaaaaaaagttaaaatacaaggtggtaaatgtgataaaagatacaatgttctgagtacctgaaagagtgagcaccaccctaaacaaccaggagacaatcaaagaatgtgttcatctatagaaagaaaatgtaaaaaaacagaagtctcaaaatacaagaaaaatagttacaagcaatttcaccctactgcagaaaaccatgcccagtgtctaacttaggctccactcagatcttttttttttttttttgagatggagtttcactcttgttgcccaggctggagtgcaatgacgcgacctcagctcaccacaacctctgcctcctgggttcaagtgattctcctgcttcagcctccccagtagctgggattacaggcatgcaccaccaagcccggctaattttgtatttttagtagagacagggttcctccatgtttgtcaggctggtctcgaactcccaacctcaggtgatctgcatgcctcagcctcccaaagtgctgggattacaggtgtgagccaccacgcctggccctcccttttagcatttcctatgcatggtggccacatgaatcatgtgacctcgtaataaactgatcttccacaagtgcctcattcattaaatcctgctcattaaaagttgggctccaaactacaattaaatccatgtatttgatctgtgaccgaaaaattattatattaaaggtagttattacacaggtaatttcattaaaaagaagtctgggcattttaaaatagacttctagaatcatctgccagcttgacttgtacatcttgactgaaactaacagaagaaaggtattactatagatctctgatacagaaaggtcaagttcaagaaattcagtcaaaaagcaaaaacagaagaaagtgaagggtgctcagaaaaagtccaagctaagcacagaaaaaaataacagagatttaggctgggcgtggtggctcatgcctgtaatcccactttgggaggccgaggcgggcagatcacctgaggtctggagttcaagaccagccctgacaacctggtgaaaccctgtctccactaaaaatacaaaattagccaggtgtggtggtgcatgcctatagtctcaggtactggggaatctgaggcaggagaatagcttgaacccaggaggcagaggttgcagtgtgccgagatcgcaccactgcactccagcttgggtgacacagtgagactccgtctcaaaagaaaaaataaaaatagagattttaagcaggctgttatttacaactgctgcaaatattcatataaaactactatggatttagccctagtgtcctcaaactttagtgccaataagaccaataaagtagacagaagacagattgcaaaaggaatgcgtctccatcctgtaggtaaacaggtatcaaaattttatgagtaccagcgtcacccagggagcttggcaagaatgtagattctgtgccttaaaacactagatattctccggagaggcactgagagccagatttttaacaagtcctctctctctctctccacctcccactccccagtcattctgagggaggtgaatggtaggtcacttctgaagaagcaatgcaggccgggcgcggtggttcacacctgtaatcccagcactgtgggaggccgaggcgggcggatcacgaggtcaagagattgagatcatcctggctaacatggtgacaccccgtctctactaaaaatacaaaaaattagccgggcgtggtggcgggcgcctgtagtcccagctactcaggaggctgaggcaggagaatggcgtgaacccgggaggcggaggctgaggttgcagtgagccgagatcatgccactgcactccagcctgggcgacagagcgagactccatctcaaaaaaaataataaaagaaaaagaagcaatgcaatatttcaggtactatcctagtacttttgtgtgtgttgtctcatttactcctcatgaagatcacgaggtagctatttccctattttatgaatgagaaaacagaagcccagggtttaagaggcagaaggttaaacaactaaggagaaagaaaaaggacagaaaggaaatttgctctattcgacagcgatttcaaagtattctaaataaagaagctgacattctaaaacatcattaaaaacaaaagtatcaatagatcagaaagcttcaatatcttgtgtcattcagagagagagagagatgtggaaggccaatattgaaagttataaataactgtttaaatatttaaaatgcaactcagctgtttgtagtaggctgtacgtaagccaaggtagaggctgaaagtacactgtatgaagttatttatgcttaaaatttgcattatttgagcttgaagtctttattttttttgagacagagtctcgctctgtcacccagtggagtgacaaaatcacagctcatagcagcctcaaccccccaggctcaagtgatcctcctgcctcagcctcccaactacctgggactagaagtacgaccaccgcaccttgctaattttttcctttttttttttttttttttttgtcaggacagggtcccgctgtgttgcctaagctggtctggagcttctgggctcaagtgatctcaccttgacctcccaaagtgctggcagtataggcgtgagccactgtgcctgacttaagtcattttcatagatgaattaaataaccacctataaacattcgctgtgacatactatttctggtgactacacagaattatagatttgatactaataattcagccagtgaccctaatcttactagcttccataatcagtagtaccaactaagagtggtaataataatcaagagaaggagtcagtttcaaaaaatactcagaaaatgtctcagatgttatctgcagacagagtgctctgataatcctgcaaatttcagtcactgagacatttattgaacatccttgtgtacttagcaatgaactagggtcttgggattcacagaaaaataagacaaggtctccgtcctcaagaaggctaagaccacagggcaaataactaataaaacctaataaccaaattaagacctaaattatataataatacctaaattccaccgaccaatcgctgagggctggactcaatggctcacacctatactcccagcactttgggaggccaaggggagaggactgcttgagcccaggagatcagtctgggcaacacagtgagactctgtttctacaaacaattaaaaaattagccaggtatagtggcaggcacctgtgttcccagctattctggaggctgaggtgggaggatcgtttgagtctgggaagtcaaggctgcagtgagccatgatcatgccactgcaccccagcctgggcaacagagtgagaccctgtctcaaattaaataaataaatggtcttttaaaaagatcaatcaatgagaactaagtagagcaaggaaagaacacgtattaagtatgagtacctgttatacacaaaatacttccacatgttttatctcttttaattctgaggataatctgaagaggcagggttcaagattaagaaaacaaagttcagagctgttaagtagtttgccccaactcacataactcataaagaggataagacaagggaaagcaccaaagtgagagtaagtatgaccggttcacaaggcactgagaccagtcagactaaaacacaggatacactgggaaataaagctggccagagttgggccagattagaaaggaccactagttatgcttgatgaaataagaatctgtcagccgggcgcggtggatcacgcctgtaatcccagcactctgggaggccgaggcaggcatattacctaaggtcaggagttcaagaccagcctggccaacatggcaaaactccgtctgtactaaaaatacaaaaaaattagctaagcatggtagcggacaccggtaattccagctagcggggaggctgaagcaggagaatcgcttgaacccaggaggtggaggtggcagtgagccgagatcgcaccattgcactccagcctcggcaacaagagcgaaacttcgtctcaaataaaaaaaaaaaaaaaagagagagaaataagaatcagtcattaaaggcatatttaaggaagactactaatatggcaacacttcatagaacagattgcagtagggaggatctgcaaacagatataatcaactaagacacagctctagagaggagctgcccctggctgataccatcggtcctctagagaggagctgcaggaactgaccgatactatcaggtaggcaggtgttgctccaagctggccaggccctcacagggaggcactggtgtccttctgttgaacatacacaatttcacagaacatggacctcagacaaggccactctgtgaccgtgatggatcaaaacgaaaacaagaccactctgtaatcatgtctgaacgcaactctgttcaactaccgatgtgctccctggctggacggcaggaactaaagctagagcctgttctaggatggtggcagtaggaatagaagaaagaaagcaatataagtgacatttccaagtaagaataaaaaaaactgttagtaggcaattcaagagaaaaagttgagactcatacatcgcttgagtggatagcatccaactgaaatattataaatctaatctataatatttaaaatctatatttttatttaatctagttaaattagtccatgtttttcagactgaataaaagatgatgacagaaaaatatttagtaggtaattagagattaaaaaataatgatgcctgcgtcccacctccaaaggctctgattcgatcagtactgagtgtagcctaggcatcaggatttttccaagctccccaggtgattccagtgtgcagctaaagctaagaaccggtatctcagagaacgccgatggctcctgactaggaggaaaaaggacaaacgatggatagggtagaaagggacccaagaaagtactggggcaaaaaggtaagcgagaaacaaaaaatggctgaaagactagacagacgattcccagacacagcaagagtcatttaaatgatgaaagagtcactatttaacaaacgatagaaaccaggcaagaaggttaacacaggtttagatgactaggaaacatgaccaacaagtaaggccactactctgcattagcaaaatcttcagctaggagactttcaatctatgatcctctgaggatgcctggataacaactacatgtaccactacaaatagatgttaactgtgtacagcctgtttctaaatatagaggtggattcctccagcccttttccttcctagtgttcccacactgccacctcgtgggtcagcactgcaaggagccggtttgaactggaagggatttctaactggccctgtaaattcacaaggcaggtacatggtaaagcctcaattcaagggtttaatccttatgttttcctctgtttaattacagtggaagacagccttaaggtacattgtttcttttgtgggtgataagaattttctaaagttgattatggtgatattagtatgtacttaatgccaccgaagggtacacttaaataaataaaagggtaaagttaatgttactttatatcactttaaataggcaaatggtatggtatatgagttatatctcaataaagctgttacaaaaaaaggaggaggtggccaggcacattggtctgtagtcctagctactgggggggaggagaggggggctgaggtaggaggatcacttgaggccaggagtttgaggccagcctggacaacatagtgagaccttgtctctctgaaaaaataaataaataaaaagaaagaggagtaggaggaggcagctgtagcaaatacataaatggtttctaaaactgcagaaaacttaaaaaggatgtcagaaatcactcaataccttcatttcaaaaaggcaaaactgagactcagattaacttacttaccctacttacccaggcagtaaaaactaggccaaaaaggggcactattaacccatttatggaggtcttctatggtctcccaatcctgagaagctttttctcttaagcttgatcctcagcaatgctatcttttgctgcctaacttactactgggagatcacactcacaccaatgacttcacagagcagtagtatcaccactattccaatagttcaaaacccagcactcacccttcaccacagagcactactgtcaccactattccaatagttccagctcaaaacccagcactcacccttcaccacagagcagtactgtcaccactattccaatagttccagctcaaaacccagcactcacccttcaccacagagcagtactgtcaccactattccaatagttctagctcaaaacccagcactcacccttcactgcttccttgccctttaatcggtcaacaacgtgggtgaactcctcaacatgtttggttccaggccctctaccagtcccctagctcaggccttcatcacttcacatctagaataacgcacattttctcctaactggaatcctcatctccagtctttccacttctctccctcatcacaaaattcacccaaatcaggactcctacacaaatcttccatgtgcacctcatactgcagcccaaaaatctctatgggctcctcaagagttgtacctagaaaataaagttcaaaatctcttaacctcagcaaggccttctgtatcacagacgctatcccaacttataatctatcatctatacaaacagcacttcgctgcagtcataatggtctactaaacaatgtatgcacatttcccaattagttattcctccatagttgttatctctaccacttatttcactggtatcatgactttttttttattcctttcccaaaggttctcaactctggctatgcattagcattacctgtgaagctttaaacaattatgggacccttaaggatgttgctcagacatctggatatttttaaattccacaggtaaatgtgtaaaataccaatgattcatagattttaagtaagtctttttgtaagatgcttaagttttcaccactaaaactgagcatccaatattagagtcaaaaactcaaaaattaaactgcccagagaaactgttacctactacccaaggtttcttgatcattggtacaacataaatctttccaattaacatctactttctaacaagacgtaaacacagcagctaaaaaatgctaacaaggattaaatttttatatactcaaattcatttgtgagaaacatctatcataaccatgccaattaaaaattcaacataattcctgtttgtcctacctatgacaattatttaaatgtaaacagaacatgctaatgtcaatgtccagtttaaaactgaacatgcagaattatttatagatattataagcagttggactaatcccagctgtggcaattttaccttagcccttggatataaaggcacagagaagcagggagtcagtgaagatggaaaagaaagataggagctgtcaacccagactgctctataataatctggggagtattaaaaatgtctatgctctgccgggcgcggtggctcacgcctgtaatcccagcactttgggaggccaaggcgggtggatcacgaggtcaggagatcgagaccatcctggctaacacggtgaaaccccatctctactaaaaatacaaaaaattagccaggcgtggtggcgggcgcctgtagtcccagctactcgggaggctgaggcaggagaatggcatgaacccgggaggcggagcttgctgtgagccgagatcatgccactgcactccagcctgggtgacagagcaagactccgtctcaaaaaaaaaaaaaaaaaaaaaaaaggtctatgctccagccacactccagacaaattaaatgagaatctctgagggcaggacccatgcaccagcatttcttaaatctccccgagtgctttcaatgtgtagccaatgtcgagaaccaacgagttacaagggaatttctcaaaggaaatctaaagatgagagctgttcaaagacaaacacaaagagggaaaaagtcccaagaactagttagttacttcagaagtaagttgctttctcttatcagtttatgaacaatttttacatattacaaatatacactttttggccatgcgagtgactcacacctgtaatcccagcactttgggaggccaaggcagggggatcacttgagctcaggagatcaagaccagcctgagtaaatggcaaaaccccatctctaccaaaaataccaaataaaaaaaaaaaattagccaggggtggtggcacgcatctgtggtcccagctactcagagggcggaggtaggcggcttaggtggcagaattgcttgaacctgggaggcgaaggctgcagtgagctcagatcatgccactgtactccagcctgggtgacagtgagacttcacctcaaaaaataataataataataataatattcctttttatgttgaaatattttcgtcagtttcttgattttttgttgttgttgttgttattgttttgatatggagtctcactctgtcgccaggctggagtgcagtggcatgatctcaactccccgtaacctctgcctcccgggttcaagcgattctcctgcctcagcctcccaagtggttgggattacaggcgcacaccaccacgcccggctaattttgtatttttagtagagatgggatttcaccatgttggccaggatggtctctatctcttgacctcgtgatctgcccgtctcagcctcccaaggtgctgggattacaggcgtgagccaccacgcctggccagtttcttgatttttttcattataagatggttcattaacataaggatgtttttaacttttatatattcaaatctgcccagtctatcaatctatcttatccccttgtggttgctcttatttatttttgctgcaaatgctataagaacaacaaaaagaggacttgcttacattataattctcaacccaagtaatgaattttaaaaatcagtattggccagatgcggtagctcatgcctgtagtcccagcactttgggaggccgatgcaggtgaattgcttgagcccaggagttcaagaccaggctgggcaacatggtgaaaccccatctctacaaaaaatataaaaattagccgggcatggtggtgcatgcctgtggtcccagctactcaaggctgaggtaggaggatgacttcagccaggaggttgaggctgcagtgagccaggagcacaccactgcactccagcctgggtgacagagtgagactctgtctcaaacaaacaaacaaaaagatcaatattagcctactgttataaatgcttttaaatgtttaaaactaaacatgaataggccgtgtataaaacagtaaactggcaacaagtaaactttaaaaaggaaacattcttgattgtactatatttaaacaactagtaatggctctgtccattttcacttttcaaatagtagaatgagatataaaacacaaggttatcccacaagtggcctttattttttctatactaacaagtaattattatgtcaaaaactaggggaaaaactcatttacacagaatcttcttgtagtaataaactgtaaggagatcaacaagcacaattttccctccagatcataccaactccaagtaaaactactagtttcaaacataggtttcgactcttattgtgaaaaacatggtcatcatcaataagccactataccatgtaaatttcattagtgagttttatatagatatttatgacaaaatttaacttgtttgcccttttttggtctaattcaaaataagagttaatggcaaatgtcagaggctaagaacagtttggaaagggggttcatgaaggagaccactcagagacagtgttttagtggctaaaaaataagttgcctttctgaaaaatatttgtatgctttttactccattgtccaccagagggagcatcacatctgattaagagataatggggaactcccagatagaaatggaaaatcatctgaaacttgatctacgaggtgctacagatggtagcatatacagttaaatgtaaaatcaaatcagagaacccccaaaagaatctcaaagtgagtgggaggacagcctcctagggagatctcatctctaaaaaaaaattttcttttaattagctgggtatgatgttgcacgcctgtggtctcagctgctcagaaaattctggaggctgaggagggaggatcacttgagcccaggaattcaaggctgcagtgacctatgatcaaaccactgcattacagcctgggtaacacagggagaccccagtctctagaggaaaaaaaaaaagaaaaggaaaaaacaagaaaaatgagcaaaagataaatacagacaaatcacaaaaagatataaatatggcctttaaacacatgaaaagatgtttaacttcacccataatgcaatttaaatgcaaattaaaactatactaagatcccacttctcacccataagcttagcaaaaattcaaaagttcaggctgcaaagctaagggaaacaagtactcacatacatcattagtgggaatgcaaaatggtacaaccccacataggtatttacaccttgacccagaaatcccattttgaggaatctaccctgaagatacaccagcaacaatataaaaatacacacatgcaaggttattcattagagcaatatgcacaattgcaaaatactggaaattgcctaaatatccacacataggaaattagaaagtacagtggatacataaaattgagcattatggagctataacgaataaggaagatctccatgaactgatagtagagtgatttccagtagacacaaagataatgaagcaagtgcaaaactaagaatggaaaataagaacacacatataggccgggcacagtggctcacgcctgtaatcccagcactttgggaggccgaggcgggtggatcacgaggtcaggagatcgagaccatcctggctaatggtgaaaccctgtctctactaaaaatacaaaaaattagccaggcgtgatggcgggtgcctgtagtcccagctactcgggaggctgaggcaggagaatagtgtgaacctgggagacggagctggcagtgagccgagatcgcaccactgcactttagcctgggcaacagagcaagactccgtctcaaaaaaaaaaaaaaaaaagaacacacatatatacttgcttatcttaaaaagaaaaaatataagatgaaccagacgctacggtctgaatgcttataccccccaggctggagtccagtggcacgatcatggctcactgcagccttgacctcctaggctcaagtgatcctcccacctcagcctcccaagtaactgtgattacaagggtgcacaccatcccacccagataattttttgtttttttttttaacaagatgaagtttccctatgttgcccaaggtggttgtgagctcctggcctcaaatgatcctcccacctcgtcctaacaaagcactgggattacaggtgtaagccaccacttgattaagccagactttagagagacatgaaaaaaatgtaaagcaatgcaattctcattaaattttcgttgttttaaaaaatacacacgggcctatagtcccagctattcgggggactgaggcaggacaatcgcttgaacccaggaggcagaggttgcagtgagccgagattgtaccactgcactccagcctgggcaacaaagcgagactctatctcaaaaaaagaaaatatagtttgattccttaaaaaattgttacaacataataaatttacatatatgtaacaattttttaagtaaccaaaccatcaaatatacacacacacacacacacacacacatatatatatttttgttattgttgttttgttgttgttgggtattttttggaggcagggtctcactgtgtcacccaggctggagtgcagtggcgcagtctcagctcactgcagcctccacctcccaggtgcaagcgattctcctgcctcagcctccaaagtagcttgattacaggcatgcaccaccacatctggctaatttttgtatttttagtagagacggggtttcgctacgttggccaggctggtctcaaactcctgggctcatgtgatctgcccacctcggcctcccaaagtgctggaattacaggtgtgagccaccacgccctgccttaaatttatgtttaaataggtattttcaaaacttagttttaatttttatgcaataaatataaatagataaaacccacataaacaaaacatcatcagcactctcaataacgttttttaaatccctatcaaatccattttgataatttgtaaaaggataaaggggtcctgagactaaaaggtctgagaaccactggtctataacaccagctgccttaaatgccagagtatgttaagagcaggggctggggctggggactgtatcgcttctgttgcctgataatgctggattctgcactaccatcaccacagacactgggccctgctgctgctgctgctccttgggaaactggttgttgctggagagtgattctctcaaccattcttctttgtgatactggcttttattcaaagtcctcagagagcatcttagattgaccgaacttaggtcactgcccgcaccctagctgcaagggaggttgagaaggtatttagcctttttggctttttcgatagaaggcagacttggtctacatcccaccaatagtcttccaatgaggaaatcggcaaacataaacagtcaaaaccacaagcattagcccattgctctaattctttctgggaaggtcagaggcaaccttgtggggaatatcacagctctatcaaagattctcagtggatcttagagatggtggtattacacacagggaagacaaatccaagtacaggaaaaaaattgatattccaactgactcctccatgacaaaaagttctaccataataacccgacacaaggtggctggctggtcctgaagatgtgttgccatttggggaatcaggaccagttactactggcagcaaactgggcactctgtaccagcagaagccacatggctatcatgaggggaagtctgtattgttgagttccaggcaccagcctctatccccgtccccatggttgctctgttcttgagccttttgagcaagcaccaggctgtctgaagaacaacttactgctatccacaaagcaggtcatcctgtctgattaagaacgccctctgctgtggcattcacatggaccaaatgttttcaccagggctcagccataaagccctttcccaaacctcgttacagaagaaaaggaagcagtagaagaaacaggaattatgactcccacttaaaaagaaaaatgtagtcacatccataaagtcctttcccaaaccacattattatcaattcttccaccttatttcaaatcctagacccattagccactgcccaggaagttgcaaatcctacttcaagccatcgttcaaggttctgctctttgaaatgattttgctagttgcttgaccttcagggcctccaaggaagagtctgtaacactgcagcaattcacttacgcctggtgctaaccatattttacaaaatcagccgtaaacccagtaacgtctttttacattattttcacagaggtaagtgcttccttgtctccactagcctcttctactctactgacccttaaaccttgggttattttagccaatgtgagaattctgcctttgctgaaactattcatgccaatgtctaacattcttagtaacttcattatttagataattcaactaacctcagcctttgggtttcctgaccaaaaatcttttcttactccctaccttggccacattctgccacaccccgtacctgttgtatcaagacacacactacttctaagcatgtacatatcaagtcaacccattatctgaccactcaccatttctctgaccacatgaggacctctaatccattgattcggccacatttcactggccatcaccttccttacgacctcattccctacctgagaaaccatgatccacaattacaccctcccttgcctacaacttcaacttcccgtcccctctctccgtccatcatgctaacctagcaatcctaggtaaatccagttctcatagccaagcagctggcaattgggagagaaaggaaacatgacccaactaactgttcccactttaaataaacaaacacaagttttaagtagaccctcagcacttttcaacaatcctacatttcacgaggcaatttatgcttctctcctagaagactatttccaatctctcctaaggctgagtcacttagcaaccacttccctagcggtccttaaacttttcaatcaccactgctgttgccttttctggcacctcttcttcttaccctcatatatgaagatgttcccttccatctccaccccaggttcagtccttggccaagagacattccatcatctcaccaaacacagtgagttattaccctttattgcctggtcacatttactcacactgcaactcaaatgcagctgcctttttttttttctttttttttgagacagggtctcactctgtcacccaggctggagtgcagtggcgtgatcaccactcactgcaacctccacctcctgggctcaattgattctcccacctcagccttctgagtagctgggactacaggcatgcacccaggtaattatttgtatttttagtagagacagggttttgccatgtcgcacaggctcatcttgaacttatgggctcaagcgatccacctgcctcgacctcccaaagtgctgggactacaggcatgagccaccatgcccagcctgctttatcttctataactcatctaatctgtctcctgaatatgcgccattttttctataattaatctaatattcctcatgaatatctactctaataaatatccaggaaatttaaaacttgtcaaacaatatctcaatctcttccagttaatactcagactttgtttaactccttacccgggctggtttaaatggctgctttcgggtagatttccctccaaggtcttatcggacatcctagaagaaatagtggcaagaagaccttggatctgtgttgtttctctggatcctcactggtctctgctgcaaggaggtaatcaggtcctatggctgaactggtcccatctcatcttttaggatgtcatgctggctctcatccctggagtctgtgatcctgacattcagtctatagtcacacagtcttttgtcatgacgccagctgttccaccaggccaataagctcctccacctccttcacagtggtatgagagcatttcagaatcccctggtaccacaaactcaactatctagccacttccttctaccactgctgtgctataggcccgtgttggcctatcactaacctgcataacatctcctctcaagattccacataaggagcagagcaaaaggccttctactgctgaccgtcccctcaacccatttaacatccccaccctaaccctagaactttagccagccaagaaagatcagaacacatatttctcacaatctgttttccctacctctgtccccccgctgcccacaatccaccaggactgaaagggatgacacgtctacttccaagtcatcctccttcctcctgggaggcactaagcctcattctcagccttaatgccagatgagctattctctttaccctacagaagaaactatcattagagtttgccagaagtaactcttgatatggaagctgcaggcaacttggaacttgagaaaaccaaagacaaacatacagcgacttcaagttccccaaaatattaatccttgaatgattaacatctcccatgtggtaggccctggggatataaaaaagattagacttagagcactacactagggagtgagaaggtttacaaatacaatcataacaatggaattttatgtgctgcactcaccaaagcaaacgggaaatacacataactcatacccaattgtcaaccaacctgttctacctccatcaaattaaaaatgcatgcaacggcagaaggacaatataagtgatttcaggccggggacagcggctcacgcctgtaatcccagcacttaaggaggctgaggcgggtagatcacctgaggtcaggagtttgagaccagcctgactaacatggtgaaaccccatctctactaaaaatacaaaaattagccaggcgtggtctgtaatccaagctattaaggaggctgaggcaggagaatcgcttgcacctgggaggcggaggttgtggtgagccaagatcacaccattgcactccagcctgggcaacaagagcaaaactccatcttaaaaaaaaaaaaaaaaaaaaaaaagtgatttcaggttataatttcattgccatttactctttctacaacttacatacttcattttcttttccaggcacaacacggaaaaaccagaagccattccttaatgagaggaaaaaggtaagataagccatgaagcaggttcacctttctccattaacaaaaacaagtatacagaactaaagctactaatcaaaacagctctagagcaaaggaaatcatgtaaaacttggtaaccattgtttctggagcctaaggaagtagagatgtgcatcccttaaggacatcatgaggtgatttcattgttgtaggaacatcatggtgtatcctcacacaaacccagactgtacatacagcctgctacacacctaggctagcaggtattgtctgtactgcctactgctctgaggctataaacctgcaccgcgtgttactgtactgaatactgtaggtaactgtaaaacaatggtaagtatttgtgtatctaaatgtacctaaacacagaaaaagtacagttaaaaaatgatataatcatacagggccactgtcatgtatctggtctttcgctgaccaaaatgtcgttatgcagtgcatgactgtaattatcatcaatatctgtttttttaattctattttgatttttcctttcccatgtaactgttaattgctacaaactaacattttcattccatacttaattcagatggaaggcagcagaaggacaggggcagttaggaggaaaattctgccagacattcatactaaaactaagggcttactatgtgttagacactggggctacaaaaactgaaagatgcactattcttaaagacttcacaatggacagtgaataaagagaaacaaattttacttacaagatgacaagtaatacagaaacttatccctcaaggacaggcattcaacagtggcagaaaactgcatcaaacaatgcgctaacatttccctaacactattttcaggttgcagtgattcccaaccaggctctttggaacactataaccactaaaatgggagtgttcaaacagagcaactactaccacaacacaagtgaactgtgtatcctggcaatccaaagtaagtgcaaatattttgtgtctgtgtaaaatactagtaagtatttgtcagtcattatgaagaatctgtttagcttgttttgtttagatgcttagcatttacttatatccctttttctatgtttatgtttgctgatttccccactggataactatcggtgggaagtagagtgagcctgccttctatcttaaaagccaaaaaggctaaataccgtctcaacctccctcgcgctaggggtgcaggcagtgacctaagtttagccaatccaagacactcactgaggactttgaataaaagccagtatcacaaagaagaatggttgagagaatcactctccagcaacagtgagtttcccaaggagcagcagcagcagcagcaccagggtccagtgtctatggtgttcgtggtacctactgcagaatccaatattatcaggcgacagaagtgatatacaccccagatcccagccccagctacttttgcagtgcaatcctaacttggttcagccgatgcccagtcaagtcttggcagactttaaagcaacactgagaactcccccaaaactctttcattaaattccttttttgcttaaatccccagttactgcaaacaggaaaaatgaatgagactaatgaaatagtatggtaaatcaacaagcatcccacccacaaagggtttgtgtagcttattttggaaatgcacaattccgtgtgtcacaagactcaacttcagctctaatgattcaattgccaatttgtcaccatttattcattccaaaacttttctgttccaagaactatcttgaaaggaacgaattgttttcaaccacacagtttacaaaaacttcaagatgctgctctctcccgaacagatgttttcgctgttatcattacttcagaaagcaacagacaaaattattatttggtagctctaaaatgcaaagtcatattcctgaattatgaatcaaatgagaacaaagtaagaacaatggtcaaattacagatacgagttttgcacttaccgtcccacctccacccacctaaatctcagactggcaggtctgaaaagcggccatgcacaaaatcatcgcactcatctcaaaatagaactcttcttcctcgcacacagaagctcaataatatttgttgactgaatgcagttcctattattcatgtatgttacacatttccataaattgctttcacatagcactttacaccggcacagcgcgtccaggcttccaaaacaccttcacgtgaatccctgcatctagaatggtggttaagagttagacatgcctgcacagccattaaatggcacagcacacgggggacccgtgtctgatgctcccacagcacattaattgcccctctatttcagcccttctggtacactgtaattctctctctcacttgatcagctctttgaggaggtcccgttcctcttcgtatccccaggccacacacaacccagaccacagaggtgcaccgtagacatcaagattcttccacctgctgcaagcctgatgctttaccggcggggcctctgcaggggagcctgatttatactcatcccagctcccacccagccccacgcccgccacgtgtgatttccacagccgcaccaaggaagactgtccagcacacagacttttcgtctcccagcaaaattatccccggcacaacgcttccccctcaagtctgcccaatggctttcccatttccaccgcagcccaggttggggggcagtggctgagcctgggccccctcccagccccgctgcggcaacctaggggggtgtccgggcggggcctgtcagcagcgacccgcccccgggcacacgcgcgtcaggggcagcaccgccaagctgcctgtgcagccccatccagcaggagtcccgcggctgccggccgcccgacgcccccccctccccagcaccccacacagctcgcgactcaggtaggcgagggcgctccttacgcacccgagaaggcagcggtcgcagacgacgccacgactccccttgcacaccgtgtacgccaagggatccgagcggaagagtagctctccggggcgcagcggggtcacggcgcgcagcccgtttcccctcttggcggttgcgaacttttccaccttcagcggctccatcctcccgcagctccggcacctcagacggctacccgcgtccagcagcgggcgtctcacgggctgccgggacccgcgcgcctgcgccctgcgcgcacacgtacgcccgaggggcggggcgggcgcggtggggcaagagcatgcgcagatggagtctggagggacggctggagtggagtgtgtgggacctgaaggtggtcgtaaggctccgcgtgcggctcgtgcccatggcgactgcgcagaagacaggcggggttttttttctccctctaacattgtattacgatcattttaacgcatacggaacagttgaaaacagtgcagtgaacacctatatacctccgcctaaatcagacaacctagcactttgccatttctgctcgtcactctctccccacctgtagctatgtatacacgtattgtcgttaaactatttcaaagttgcaggcatcatgacatcacaactagtactttgcactgtaacttttttttgttttaggacggagtcttgctctgtcgcccaggctggagtgcagtggcgagatctcggctcactgcaacctctgacctccgggttcaagcgattctcctgcctcagcctccatagtagctgggactacaggcatgtgcaatcctcccgcctgggcctcctgactagatgggactataggctcacgccaccatgcctggctaatgctttttactttcctccagagacagtctacctatgtcgcccaggctagtcgcaaactcctggcctcaagtgaacctgaacctcctgcctcgacctctcgaattgctggaattacaggtgtgagccaccacacccagcttaattttcttttttgtttttggggtttgttttgttttgttttgttttttgagacggagtctcattctcgcccaggctggaatgcagtggtacgatattggctcactgcaacctctgcctcccgggttcaagcgattctcctgcctcagcctcttgagtagctgggactacaggcgcctgccaccacgcccggctaatttttgtatttttagtagagacgaggtttcaccgtgttagccaggatggtctcgatctaaccttgtgatccgcccgcctcggcctctcaaagtgctgggattacaggcgtgagccaccgcgcccagcccacccggcctaaatttcttagtttggacaaacgtgccatggtaatgcaaaatgtcattattaagggcagctggatggaaggtgtaggagtacactatagtgcctttcaatttttctgtgtatctaaagtcatttcaaaagtaaacatttattttaaaacatgaaggtggttatgcttccatgagtgtaaagtacaaaaggcaggctcgtggtgctgtcagaagtcagaacactggtttcagggctgggggtgttgggaggggctgggcatggttggctttgtgatctgggggctggtgtgttccatctgtgaatatcttttaagctgtgcacttaccagggatgtaagtcatatcttaataaattttcataagtttgacaaaaaataaaatgaggatgggaagcttgtttgggttgtggggcctcgggtgcttatccagccatgagctgtgtcccagatgcttctagaagcctggagggagctgagaacattccaagtcgaggtggcagagccaaggccctgaggtgggagcgcaatgctgcacatccccagctgtgaatggggtgtcctggtcagaagcagtgctgtgtgcactgcagggccggcaaatccacgtccacattgtggcttggtgcagtgaaagccaatctcagccccctccacagtgtgattagcctgccagcaggtggccagctggtcctcctgggaaatggtgccaacccagagactgggtgcaagtgtctcatccacggaggggcgctcagcagtggtgtcagcctggtgagcctcggtaagggcacgtgcaggatgctgagcctcttccgttcccatgcccgtctcaaggccacttgctccgtgggcccatccagcaagcatggtggccaggaaagaagccggctccattcacagggcgtgctgttttgctcacctcaggaccaagagcatcctccatagtgattctctttggtgggagcactagaaacatgaaccacagataccttcagcgtctgagccgctgaggcgagggctgcaggacaccctgctgtcgggaaaccctgcactggcggctggaaggcatgtggtggtggcgcctgctgtggctgcagcagttgctgcgaggcttcgggatctcgccggcccctgcgaggtgaattgtgacagtgcagagctccgtggtaccagggccccctgcatggccatgctgactgcagctgggagcccaccacacctctggttccccgctcttcccagggctggggtctaggccaggcccctcttggcctgcgaattgtgccctgggagggggacactgttccacaggttgggaccaaggacccagggcatgctactggctggctgggctgcagggatgccatgctcacctttctctctcatggccttgacgggaccggcttcctcattgaacagcattttccaaggtgtctgggattgctggtggggtgccaccctggctccttctaggcatgcccgtcattggccaccaagggggccagatgcaggtgcccatgctgctgtgggggcatctcccaacttccctcttagtcctgatgggcctaggcagggcctgatatgggggtccccatgggcttccggggctaagcctgccccatggtcccagggctgtccaggacacattcagaagggacatgagctcagcagctctgtttgaaattattatggaaccaagggccccccacatccaagtccactgggagtcgggacatggagttccgctgcaggtacctccaggaaccccgaggtcctccttgagccaaggccaggctgggcacaccataagtcctgggtcccccagagaatggcctgctgccctgggctccccagaagccccctcacgcccctgggccttggccacatggaagccccaccaggacaggtgtgagaggacaaggaacccatggtggggaagcagaccaaatgggccgctggaaccaggctggtgggccagggggcacctgcccatcccccttgcagagggccttcctgccacgtgaagccagcacagccctggctgctgaggacccttgcctgggtttggctgaaagaaaaacagacgtgatcaggcagcacctccagtgggcccaaagagtcctttctgggccgggccccacctgcctgggtctccggagtcctcagggtctctcggtggcccctggggtctgacactgaggacacacctgcaggctgctgatcccagagggaggggtgtgtgtcacctggggtagggaagctgtcggggcacagcaggtggctcctgggactgccccccaggattcaggctggctgggggcttcctgccccatgccctcatcccagggctgttgggcctggtatatgatccccagtcagaactcaggtgggaggggccttggctgtcacccagcccccttgctacctcacttggggacctgtctctaccatgagtaagagggcccagatacggggccccctctgccctcctgggctgcccggtccatgccaggactgaccattcccacacctggctgaactcttggctctggctctgggccaggggtcccacctgtgcccttgccctgaaagctctgggggtcagggacaccgactcccttgtctccctggctcaaggctcgttgtcctggcacccttggagggatgttcaggagtgaggggcctctgctgctctctgaggctgtcagtgcttgcagggaggggtggggggggtcccacaaatgggtctggctcctccagtgccgtcaagggccctgttgggggggggcgggacaccgtggaaagtgggagggggcttgttggagaggtcttgcccacatccccctcctgcgtgcacagcatgtgcagtgcacatgcactgagcacctgccctgaggaccgggggcctattgtctttcttagagtccaggaggaaaaggaggaagaaaaggcacaagaggaaggcccaggtagtaggcttgggggtcccgggcgctcccccactattgactgccccagagggtgactcaggagggggcctggtatggaagcccatctgggggtggcaggtccccattcttccttgttagcttcctcgtagaggcccaagggtgcccgagagctgcgtcttcatccagggcctaggtatgggagaaccagcccccaaaactgcccatgggccagacctggatgtcttcatgaggccctctagggatagggtgggcatcaggccaggagagttccctgggagggtcagagcccatacctcattgccacctcaaccgtctcccactgggaggtgccagatccttttgtggccaccccaggggtccagatgtgcataggaggctgtggctgggggtggcctgggcagggaagtgctcaccacactccagactttcatctggaacatgtcgggggtgggcttggtgtcactgtgccctgcccagcccacccagccagacctccccctgggccagagcagaggatcatggggacagtgtgaggaagctgccctcaggccagtccgagtctgaccccagtgctccccagtgccattgggcacacgtggacttactccattaaaccttaaaggcagtgcatgccatcggcatcaacacctgttccccttctaccaaatacacatcccacaggtgcaggttgagcctgagagagatctatggggacagcagacactggaggacctggcccttcaaggctgggggctggtggctcgagctgggcccactgggacttcagtccccagagtcagtgaccctccccatgagggtcatctgacccttccaggaggctgggtcagacagggtcttgcagctcctcatgaggggcactcatttcagtgggatatggcttctggagagagggacctccccagggcttgaggcttctgagctctcccaagttgggttctgccccagtcttcccatgaggctgggcctgagccccaacctctgccgtgggatgacccttcttgggcacggggccttgcttgtgtgtcctacagggccccgtctgtgcctcctgtgggctgggggtgagccggacccctgggcacggggagcagggcactgcagggcaaagagggtccctgagccagggtctccctgggcctccttgccccatccatcaagctctggagcagccagcctaatgaggaaccctgcgcacatggcccttccttgtcgtgatgggaggaacagaagtgctcagggccccctgggctactctaaaaaccaaacctccctcttccagggtcctctgaagacccttccccaagtgcagaacacaggatggtgtccagggctccacacgacaccttccccttcccgcactcccagcggacacactgcccttagccttgctctgcaggaggtgggccccagtgcctgtgcctctgtctcctccagggcgggaaaggaaacccaactccaaacgcatggagaaccccacatcccaggtcaggccctggctgggactcagcctctcatcagtcccatgggggtctctagccagccctacgggatgcagggcctctgggaaagagccgaggggaccataaacacacagggtgcctcgtggtcttgggttatgacgtgggtaccacgtgttcctggtggtcttgtagcccctggacccttgtgctatttgggctgtagaatcctgagacgcccccagcccatcatgaaaccagagccagctcccaagatgtggagctgtcagctggaagaactgggcagctgcagaggcccccgaaccccgaggcctcccaccctcccatctgtgaccccaccatgtggccttggccctggggagaaggggtgggaacatcccctggagcctggctggaggtgctccgggaggcctcctgggccagggtgccgggagggcaggcctgactttgaggccacaacagagagtagaaagaacaaggtgggtgctgggacccctggttgtctcttggaagtggggtcaggccaggggacatgggatggggaggtgctgccatctgggctttgtcagcccacctgtgggaaccaagggcagctgaagcccagccagctggaggccaggaggactctcagggaggggagagtcagctgcatagaattcgagctggagagcgtggctccaggacatagagggcggccacggcgaggatgagatgccctctgctgatggggatgaaaggcatctgactcagggtctgggggtccccattcatccatggtctcctgtgggaccttcagcagagacatcctaaaggctcccaacaagctggtgacacaaggaaggtacctttgctgaaagtcgagatcatctggctagggtggctgtccccgggtctggctgcatgaggtcggggggcagctgttcacctaccctgtggggagtgcctctcacaagccaacagctgggccagtgcccagaatgcatcctccccaggcccataaaggagaaacaaggcagcagcgtggctcaggtccctgcggtagcccacctcctgcaagatccagagtcaccatggaaggacatctcctggagggctgaggtcacctgggaggactcatgtcatcggagagggcagaggtgactggggaggcttcctctgaagaagaggcttcctcaggatgcaaatttattttctgacaagagccatgtccatcaggcacttcagcaacttgtccaaaatgtttcctgagagcactgtcctgcatgtgacactaccaagctcctgggctttggggcagccccaggaggagggtgtcatttcttgttatgaaaagtggtggtcaggcccaggtgacactagtagttggggccctgacttctttgtctcagtttgaccccttgagaccacctcccttgcttggagatttatgccaacggtgagctggagtcctatctactatatcctgatgggtcacaaatactgactttgaaagaaacaacgatgcccctaccagacacccacgcccacgaacgtgggaatatggcccagaaacgtcactgcctgggaatactcatggggttatatgccaaatataccaggaagatgtagaataattcctgctgcctaggaaagagataaaaggggctttcgtttgttttgtgcagacgcttttagtttcactttgcctacaaaccctaacaacaaatccagtttcaggttcagatgattcaccagataagtcacaagctcttcaggaccttggttgtttaagaaatgtttcaggccaggcgcggtggctcacacctgtaatcccagcactttgggaggccaaggcaggtggatcacgaggtcaggagatcgagaccatggtgaaaccccgtctctactaaaaatacaaaaaattagccaggtgcagtggtgggcgcctgtagtcccagctacacaggaggctgaggcaggagaatggtgtgaacctgggaggtggagcttatagtgagccaagatcgtgccactgcactccagcctgggtgacagaggaagactccatctcaaaacaaaacaaaaaaaaaaagtttcagtaaaatccacatctgtgaaatgcagatatcccagttgtatagtgagttgactgatcacactctgatttttattttttcagtttgcacacccaccagttcagtctttggggtgtacagtacctccatggttctaaaccaatgtgcagagtctcctggtcaccactccagcccctcctggagcgattccttcatcctccaagtctccagggtgtcccctatgtagccaacctcttcccggtccatcagcccttggccatcccaacgtgttttctgtccctgtgatttggccttttccagaatggcctattaattggaaccctacagaggtagcttgttgggtctggtttctttcccttagcaaaatgcaactaagatccactgacgttcatgtgggcatcactggctcattcacttttctcactgagtcttttttcctttgaagggagggccacccatcctctccccattcccatgttgaaggttgtccccatggcctctgtgtgtgagtgacgatgaatcaagcagtgaatgtggcatgcatgtttcatgtgtgttaagtaaaatgtttatttagaaacagaatgcttgatccttagtaccacaaagaaacatcagcatttagacaaaaagttttctcagcaaggcaattttaccttctgcagaaagggtgctcctcacagatggaacaatggtgagagcacacctgaataaaagagggaagcaatttttatcctttatgcagcttgtccctgctactgtgtcctgtctccattggctggagctgggccatacaatctaaactaaatctgactggctaataatttaaaatgtctctaaatagctgaaagcaatggagaacaaaggaaaagaggaagctgcttatgaaaagacttagaaaagtaataacattcccaaataaggaaggggcacaggcttcaagctgggacctgcctgtgagcacgtccagcacagataaccctgattgaagtacgaggacatagaatgtacttattcctttatatctaacagctgtgtagaatagggcttaacaaagagttattagcacaaagcaaggaggcttgaaggaaattagtctttaaaggaaactgttatttctaacacttatgatttattctttaacaagaagggaaactttgaaaaggaactttttactttctacagtgtggatgtcagttttcaaatcagttggttcaatgtctgtgacacttcggggatgtgtggtttgagtccactgagctttgcgagcgactgcccaactggcttccaaagtggctgtgtcatgtcacatttccaccagctgtggatgagagtctccggggccccgaatgcccccgcccccagcattgggtgctgtcggtgtcgccagaggagtctccggggccccaggtcccccccccccccagcattgggtgctgtcggtgttgccagaggaggttcaccagccctccatcctgctgccccccacccatgggtccataccatgggtcccatgggtcagggagagcacttttcaccattgtgcatgattttgtttgctgccttctgtctcctcaggatccttctgggttctggccccacatgttctagcctggcccagagcttggaacctgggaggtcctcagtgcatggtacgggctcctccctgggccaggagagcccttggcagctccgtcatccctcctgggtgaagctggtttttgctctggggaagtctccatccctctggttcacttcatctctgctgggaccctgtggcccccataggcttacctgatgccatatcatttcctaaatattatgtgattcctcagtgtccggctcacctccaggtcaatctggtggataggttcagaggacctcttgcccttttctttcatgacctgtagggcatggccaggaggaggaagcagcctcagaacagatggaaggacccctgccccagatggcagtcagcccacagtcagcactcgtggaaggagggaaaaaaggaaggtttccttctgcagaaagctgctttttggcttgtttctgaagccagggagggtcaccagagctgagctcatttggggtgcctatgtcaccgtctgcccaggatatgcttctgaccaccccagccccaccgataagctgggctcgatgttccctccatctggagacctgggctcctgacacagcctggcctgtttgttgtgctctggctgagtatacctcatatttcccagggttctcaggcttggtttcctcaatgtttagcaggactgaccacacccagccccagaccttcaggagaatgcctttgtacactctggcagacaactgatctggtgacacaggccacagggtgacctcagcaaggaccagaccccaaggattctggaagtctctggttttggccccatgattcctcaatacaggtgaggtcaagctgggacagggtctctcctcccagggctgaaagagtgggtcagcactcagagtctgaactctgatctacacctgttccttcaccaggaggcttccctagccctgatctacggtggccccagccctggcatcagattccctcccagcaaggtgacgagcgcacgaatgggcagcaaagctggcgaccaggcctgctgtcgtctgagtaaggacagggtgctacccgctctctaagaggcagatggtgccagcccacagccaagggtgcctgtccccctgactctgcagacagtggttctgcaggcctctccctccccacattaccttcttgctcatcctatatttctgccattctcccagcatcttcagccacttttccatgtgtctcatgtcctgtcacatttgctgtcaaatgaggaatgttggagttagtggagccgccatgcttcccggagtggcccacggatgctgggtcctgggttctggagctctagtgggacccagctggaaggagctagggaagggcagaccctgggggctgagaccctctgagcaaatgagcgccagtgggctggccttgtgaccctgggacgtgccatcctcaggccacagacacaccagtcttaggtcgggtcacagcctctaggtggtatcctgacacaagcgggcagccacccccaagccacgactgttgttctcactttgaaatttcggcaaactgccagagaaacagagacttggggtcaggtccagcagggacagctgcccctcccagtgacagtatgttgctccctcccacccaccaccacccaggcccgctgcctcctctgcctcaccgaacacccactgagtccccatccctggaccagctccccaagcatcagggacaggctcttaccttcacctccagggcattgacagggggcaactctgtctcactggaaggcacctgacagagctgaggacctgcgcagggcctggagccatcccggtccaggagtccacccccagaaaggactggctctgtccccttccatcccaggtctcagctcgggagaagccacagggaagggaggacaagggccctgtggggcagactcccaggaggggcccctggtgtgggggatggtcaggctgcacaatggggctgcccctcctggactggaggtggtgttttctgctggagctcagaaacgtcagctctgagatgggactgctgctgcccagggtgggtggccacgcccggacgggagtctctcagggagtgaccgcatcaccctgctggggtttgggtgcctggcctgagacctgcctggtgcacccggggcccatcccacctgacactcccaaggtcctcgcagagtctgaccacctggagcccacctgcctctccctgcacctgagccacacaccctgctttttccctgatttccgccatcctgtccaacccaaaaactgtgaacgtctctccagccaccctgggtctgctttgactctggtcctgtcagaacccctgagtgagactccccggatctgttctcatgcctgccttgcctgctcgagagatgccaggggtggcctgggtgaccgagggccccacaggcttccaggacagcctcctggccccacctcctgcctcacctggctttcggagccattggctgtcagccctcagcctcctcccagacactgcagcagatggaactcgggacacctggccgttctccccaactatcctgcctgccccaggtcagtcccccgatcaccctctgcccactgtgctgtccaagccaactggaagcagagtccctggaaagccacgtagaatcttggggatggactgactccctctgctgagaagtcccaggtgagctggtgttttcagccccaccccatctattgtcctccccagacaatcagctccattggggtgcatttccgacgtggcacagcccatgggcttattcccatcccacctcccccagggtcctctgtctttccatcctgtgacccctgagggattggctccaggctgggctctcttatctggccccagataccgtcccagtaccagacccagggcctttagccacaagctctgctgcccgcctggccagaatgcctagaatgggggaccctgcccatcttctcccccattcccctaggcccacagccctcactgtccccatggggaagggcatggtccttgggggaaccatggcatggtccatgcggaagggcatggggacagtgagggctttggccctaggggaatggggagaagaagggcaggtgggcccctcagagacctgctggacagctgccccaaggctggaccaggtgccccctcaccctgtggccacaacccttggatctcactaggatagtgtccaagtggacagggccagaccctcaagctgcctgcctcctcttctgctaacttggagacagaactgctgagagcccaggggcctgacctagtcccctctccattcccacctgctccctagatgagcaacactccctagatgaaccacactccctagatgggccacgctccctagatgggccacgctccctagattaaccacattccctagatgagccacactccctagatgaaccacattccctagatgggccacgctccctagatgaaccacactccctagatgggccacgctccttagatgaaccacactccctagatgagccacgctccctagatgaaccacattccctagatgggccacgctccctagatgggccatgctccctagatgaaccacgttccctagatgggccacgctccctagatgaaccatgctccctagatgagccacgctccctagatgggccatgctccctagattaaccacattccctagatgagccacactccctagatgaaccacgctccctagatgggccacgctccctagatgaaacacgctccctagatgggccacgctccctagatgggccacgctccctagatgaaccacgctccctagatgagccacgctccctagatgggccatgctccctagatgggccacgctccctagatgggccatgctccctagatgggccatgctccctagatgaaccacgcgccctagatgagccaccctccctagatgggccacgctccctagatgaaccacattccctagatgggccacgctccctagatgaaccacactccctagatgggccacgctccctagatgaaccacgctccctagatgggccacgctccctagatgggccacgctccctagatgaaccacgctccctagatgggccacgctccctagatgaaccacattccctagatgggccacactccctagatgaaccacactccctagatgggccacgctccctagatgggccacgctccctagctgaaccatgctcccttgatgggccacgctccctagctgaaccacgctccctagatgggccacgctccctagatgaaccacgctccctagatgggccacgctccctagatgaaccacgctccctagatgggccacgctccctagatgaaccacgctccctagatgggccacgctccctagatgaaccacattccctagatgggccacgctccctagatgaaccacgctccctagatgaaccacgctccctagatgagccacactccctagatgggccacactccctagattaaccacattccctagatgggccatgctccctagatgaaccatgctccctagatgggccacgctccctagatgaaccacgctccctagatgggccacgctccctagatgggccacgctccctagatgaaccactctccctagatgagccacgctccctagatgggccacactccccagatgggccacactccttagatgaaccacactgcctagatgagccacgctccctagatgagccacgctccctagatgaaccacgctccctagatgggccacgctccctagatgggccacgctccctagatgaaccactctccctagatgagccacgctccctagatgggccacgctccctagatgaaccactctccctagatgagccacgctccctagatgaaccacactgcctagatgagccacgctccctagatgagccacgctccctagatgaaccacgctccctagatgggccacgctccctagatgggccacgctccctagatgaaccactctccctagatgagccacgctccctagatgggccacgctccctagatgaaccacactgcctagatgagccacgctccctagatgagccacactccctagatgaaccacgctccctagatgagccacgctacctagatgaaccacattccctagatgggccacgctccctagatgggccatgctccctagatgaaccacgctccctagatgggccacgctccctagatgaaccacgctccctagatgggccacgctccctagatgggccatgctccctagatgaaccacgctccctagatgagccacactccctagatgggccacgctccctagattaaccacattccctagatgggccacgctccctagatgaaccatgctccctagatgggccacgctccctagatgggccacgctccctagatgaaccacgctccctagatgggccacgctccctagatgaaccacgctccctagatcaaccacgctccctagatgagccacgcacctctggcctaacaacaatcacaggctggacctgcaggggagcccgggaggagttctaccctagaaaagaggtaggcccaagccaaggagacacatcctgcctcagaaagacctttctaaaagcgaaacccatccctgagctgagatttgtgctttagagggtgagaggagcacagagaactcactgcagaatcccaaggcaatcagagatcttgtagatgttaacatgcccaggctatatgtccgctggcagcccagttccacatccctgaaacccagagggagccagggtgaggcatccaaggtaaaaggtgcaagggcctgggggtgttgtcaacttgtcaccacctgtgctcctggggagcccaggaccctttgagcagggcgcactgggagaggcctccgtccagggagcagactgactgtacctgctcatacttggtaatgatgtcccctcattcctgtgccagcagggtatccacattctctcccatgtccatcccatgagacaaatcgtccaaaggtgacactgtacccgagagcttcggagaacacctgagccactcctgccgggctcccagatgctggcggtgtgtgacccccattccatcaccacctccaggtgaaaaggggccagacacagtggcccacacctgcacgggtctctggagtctcaggccccaagcaggagtgcctccttcctaaggacttgagaatagtgggacctggacagagaatcccgttgtccccaaatgccatgaaatgggaacatatctatcccaacagaatgaaaggtgtccacctgccgggggtgaagagcctgtgattccagagatgaggaggcagactggggtcagggaccagaggtctctgtatgatcagcctcttgggatcgctcagaaaccacaaagttgcccagttttctatggacaacaagatatctcctgacttcccaattctactccactcatcacttgggctaccatggcccttcagtctgaccagtgaagccgctttaggaatcatgccagttgagcaggaaggtgtttgctttgggggaagaaaatgatctattgtctccaaagcagcctctgtgctggtggaaaccatgacgctgggggagggacggtggactccacaattctgagctatccatacagggtgtggggggcttcattttcccgggtcactgagaaagaacaggagaactctgggttcttggtcctggagaacaccgagatgaacgattcctcctgggaccactcggggcaaaagggaggcgaggcctctggaggaccaaactgagaaagaaatacttgaagagaatgccagtgcctgtacccctttgaacaggagggaagatagtctccatccaggcagccctccagggctccttcattttccacaactgcccaaaggcagaaggctccccatccactcccagacagggaactgtgtgtgtccagtgggtcccacagagaccatcaggacccagcttagggcacagaggtattctgaggcccctcccctccaccccacccacagtggatccatcccagcagctctgccagggccaagctctgccccattgggatctggaaccctggacacatttgggatttagggcagggaggtcacagggttcaggacttaagtccagcacggcacagggcaggggtgagagcacaacccagggtcacatctggattcttggggttacccagttaccgcctctctgaccccagatgtctcacctgtctaatgggcacatttgggagcagcacccaccctatggagccaccatgaggacgaaggaaacatatcattaaaagatcagaaatacaaaaagagataccattaagagttcctacagatactgaaacggtcattaggtaatagtattaacatttttattctgatattcaacagcagcagtcacttccctccacccatatgtgtatcgtctgcctgggcagcacagaacaggcacctggtgagtgcccagggatgaccctcctcggcagctgcccagaggccagcactacccaccccatagccactgtccccaagtcagcatgaagggaagggagaatgtcacactcacctgattctgatgaattggctgggctgagttatgcctctcatgtagcaaactctcatgaacacagaactgctcacagatagcactgtgcgtgtgcaactgctctggaacacagaggcaggctggagggcgagcgggtgctcagcaccagtgacattctgaggtcatggcacacatcacagtggggccttgcctgggtcatcagagcccagagtcagcgtcctccactgcctgaggcgtcaacatgcctgcatgcaatgtgtgcacttgtgtgcacatgtgtatgtgggtaaacacatctgtgcacctgtgtgttgcttctctggccaggcctggctgccccactcatgtctgcacccagttcctcatcactgttacccccgaggcccaggaccagcatcagagcatccatgggtgctccctaacttcagccctccccaaccagggtggtcctgggatacacataggggtggagggaagttactgttgctgttgaatatcagaataaaaatgttaatactattacctaataacctttcagtatctgtaggaactcttaatggtatccctttttgtatttctgatattttaatgatatgtttctctccatgacccttggttattctaggtagagggtcctgtggggaaagtgcctggcaccctgtaggggctcactcttctagaaatgtgatctgaaatctggctcacctgtccttccacccagggcctaggggatgccgagttccggagaccagaaagagcttgggataaaaagaaggtttaaggggaaggctttgacctgggctgggtttgcctgcgccatccaaacctgcaggctcgagtcctgagacacagggggtccagatgtcccaatgcagggccctcctcattaacacctgctcccctgtactcattagtaacctcacccatcctaccctcaaagcacagttggccctggtatccgtgggctctgcatgtgtggattcagccaacagtgggtggaaaatattcagaaaagggagtgtggatggctatgtctctgctgaacatgtacagacttttttcctgtcaccattccctaaacaatacagtataacaacccaatgacagccctagcaagtagagacaatgaaaaagaccggctcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaacctactcatctgacaaagggctaatatccagaatctacaatgaactcaaacaaatttacaagaaaaaaacaaacaaccccatcaaaaagtgggcaaaggatatgaacagacacttctcaaaagaagacatttatgcagccaaaacacacatgagaaaatgctcacaatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcacccattgtggaagacagtttggccattcctcagggatctagaactagaaatatcatttgacccagccatcccattactgggtatatacccaaaggattataaatcgtgctgctataaagacacatgcacacgtatgtttattgtggcactattcacaatagcaaagacttggaaccaacccaaatgtccaacaatgatagactggattaagaaaatatggcacatatataccatggaatactatacagccataaaaatgatgagttcttgtcctttgtagggacatggatgaagctggaaaccatcattctcagcaaactatcacaaggacaaaaaccaaacaccgcatgttctcactcataggtgggaattgaacaatgagaacacttggacacaggaaggggaacatcacacaccggggactgtggtggggtggggggcggggggagggatagcattaggagatatacctaatgtaaatgacgagttaatgggtgcagcacaccaacatggcacatgtatacatatgtaacaaacctgcacgttgtgcacatgtaccctaaaacttaaagtataataataaaaaaaagaagaaaaagaaaaagaaacagacctgctcacattgtccagctttgaagtcttggaagaagttgccaccaggatgcaggtaggggtcaatctcctccaggatccagagagcatatcagccagcttcagggtcaggaaaggagcctgacaggtctgcagtaggacggggctggggctggccgtgtggatcacgtgggcctaatgagggggaaagtaagaccatggggcaaaggagggagcatgggggcagctggtggcctaagcagaaggaacttcagagaaggggtctgcattagttcattttcacactgctataaagaaataccagagactaggttatttataaaggaaagcagctaaattgactcgcagttcaggaaacttccaatcatggcggaaggcgaaggggaagcaggcaccttcttcacaaggcggcaggagggagtgagtggagaatgaggaagctccacattttaaaaccatcagctctcctgagaactcactcactatcaggagaacagcatgggagaaactgcccccaaatccaatcccctcccaccaggttcctcccttgacacatgaggattacagctcaagatgagatttgggtggggacacagagtcaaacctatcagaggctcactctgtctcgtggctcccccagggctcaggctgagtgcagatctgatctgctggccctgctctacagcacgctggggctctgcctgtgcatccccatctgtggcttcccggcgtggcggcctgttccctcaaaaggagggtggctctgctctcctgccagccccctgcagggcacgatggagccctggccacgtcctcccagggtgagggcatgaaactgggctccttgcccttcttgctgcttgggtgacaagctttgggtcatccctaggtcctgtcactgttcctgcttctaaatggagagcattttgccacatcttcctgggagaggctgggggttcgtccttgttatttgttctatcttggtaaaaccaggttaagttatctgggcaagcagacaatagagtggcacccaggaagggtggggtgtagggtgctggcctttgggcttgcctggaccatggttggaggggggaaggttaccaggaagcaggactgtcagggctaaagtcaggaggaagtggttatgctgaggggggaggtgtgtggctggcttggggcaggacgtaagtaagagccaagctctgtcagctcacagagagggccgctggcacctagtctagaggctgtggagcccaggggttgcccttagttcctggatccagggagacttctggagcctgtgcctatggctttcaggcacagggtgaagctggtgagggcagggggaagggtgagagaggaggccttgcatggcagggcaggacaggaagctggccagagaccagtttgcagtggctgctcccatcctcacccccacccccaagcacacccctaccccagctgggcctgggcacgtgtcctctgctttggtctcagcagatcacaagatggaagctggcagcctagtgggtgtgccactcaagccagtggtgacctgtgacttctgcttcctggatcgtggggtgcccacccaggagagcacaggtatgccccacacccctgaccttgagggcgctgggaggtgggggaccaatgtgctctatccctgtgtgtatgccctgaaaggtggcctaggagtcctgtgtgcgcccatccacgtggggtcccaggagcttcaacggtggcagggagggagacgaggagggagaaagaagtggagaagaaggagagagaaagagagttggggagaagagagtgagacagaaagagaggaagagagatgggggaagaaacagagaaagagagatagggagagagacagaggaggctgagaggaagaggagagagagagatagggagagagacataaaaagcaaagagagagacagggagagaggtgcatgagtaggaggtcgggtcattcttgatcacagttccagggcaacctgtaggttgccattaactaaccacacatataataaaggcttctgcctgctgcttacagccctcaagaacctctactcctggagactaaaacctttgacggctgcccttcctcactggatgtttgtcgtgtcttctgacgaaccgtgatgcctctttgtaggaatggtatcaataaagagccagatttgaggaggagagtaacgtgaggcattccaaaccattttcagctgaaaggtctttaattaaggtttcaaactctttagtagttggattgctggcgtcatcagtgctggtgccctccttttctttctttgattcattgtttaaatctgttgaggattgaacaactgtgaagttgacctgaatagcaccttcactcctgacagtcacatcttggtaactggattatacctataataaaggaggcagatcagaaccacagtccttcagctggagtaccccagccctgggaaaacaggtgtgcagagaatgtgtgaatccttgggataaatgtggtgcatcttcctaaagagacattttcatgttgagcaatttattatttttgatacattaattaataaataaaactcaggggacaggcttgcctgggaggacttagcgagtctcacagtgtcctcagggtgccgggaatgttggctttgtttcaaacccatttcctttcacagagaacctagccatcacatggggctggatgaggtccaggggcaactgagggttcctggccaaggccacaccctagtgttacctgtaggcttctgaactaaccccagcctctgacagcccaatgggtgatggcaaccgggtctccaagcttcttctatcgcaattttcctcttctccttttcatgaccaccatatctcctatccactctctgtatgcaatgctgcaggaatttttacagttcagggaagtaatcctgttaggcgagatcaggaaatgccataagggattgctgttttcttgattttctagaaacagagggcctccccaactgcccccaaacccccaccccactgcagtgagcatctctctctttacccttggtctggagagcacatggtatttcaaggtcaaaatcgccacctagcggagtaggaatcctctccatgaggcacattgtcagccctttgcagaaacattccagcttcccaattctccctttttgaacccctctactagacaccaggctttctgccccttcagtaaatgggaaaactcaacgatgagaaggaaaatgtcctccaaaaccaaattttaatcttgatactgtcccatcagcaggaaaaccaccattcagtcctacgttctttcaaggcaccagaatattctgcctccaattaaaatggtacttaggctgggtgtagtggctcacgcctataatcgcagcactttgggaggccaaagcaggcagataacctgaggtcaggagttcaagaccagcctggccaacgttgtggaacaccatctctactaaaaatacaataaatttgccaggtgttgtggcgtgtgcctatactcaggaagctgagacaggaaatttttttttttttttgagacagagtctcgctgtgtcacccaggctggagtgtagtggtgcgatctcggctcactgcaacctccaactccctggttcaagcaattctcctgcctcagcctcccgagtagctgggattacaggcacgtgccaccacgtccagctatttttttttgtatttttagtagagacggggtttcaccatgttggccagaatggtctcgaactcctgacctcatgatctgcacccccctcagcctcccaaagtgctgggattacaggcatgagccaccatggccagcgaggcaggaaaatttcttgagcctgacaggcagaggttgcagtgagccaagattgcaccactgcactccagcctgggcaacagagtgagactccatctcaaaaaaaaaaaaaaaaaaattaataagtagattttatgcccggaagttaactggagccactacctaagaataaatactttagtatagaccataataacaaactgtagagctcaaaccagcacactccctccattaaggggccttgcccaaatgcaactgttacatagtcctccccaagatctatctattggggaaccacacaggtcacacaagtctaagaagtcaaagggaaatcaccagcagaggactagagtcacatggatgaatgtgactaatccctttgcttagttcctccgattccatggctgagggtcatatctgcattactgggcagcacctttaacagatgccagggctcagggaaccaaggaaggaaaaacagttggggggtcgaccccactgtcttcccctccatcctgagccattgaaggagggagaccaaagggatgcctttttcttgcttctctttctagatgggtaaagaccaacttcagcctgtacttctctggaatgcattctgaatcactgggactcctttgaccccaagactttgaaggaaaagcagctcattttcttttgcgcaagggcatggccttcttatcatcttgaaccagcctggcctgtggaggggagctttgattttaatactatccaacaattagatcttttctgcagacaggagggcaaatggtccgagatcccctatgtacaagctttctttgccctgcaagacaacccagacctttgcaagtgttgcacaattgactcaacttttttagcagtcatatcagacgggccaaaagggaatgactccccaaaactagagaagcaacttccaggggaacaatctgaggcagctattgagtgtccaggcccttgttgtcccccttctctggggccccctccaaccatgccattagctccttcagccctaccacctctgaaactccccacatccccctacaggaaatgcccaatggaggtgatgccactaaggttcaagttcccttctaattgcagaaccttaggaaaataagggaagacttaggtcaattttctgatgacccttatagatatatagaagctttccaaaatttaactcaggtgtttagcttctcatggaggaatgttatgctgctcctaaaccaaacacttactacggctgaaaaacaagcagctctgaaggcagcagagaaattcggagatgagcaatatgtctcctatagtaggccaaaaagggaaagagaaaatagggaaagtgaagaaaggaagaacggagaaccatcattcccaataggaagaaaggcagtaactcctgacaaacctgattggaaccccagtgataccacagatgaatggaaaaggaaaactttttaatgtgcatattggagggcctacaaagaactagggccaaacaccttaattactctaaattgtccatgataggccaaaagccagatgagaatcctgcagcctttatggaaaggctgagagaggcactaataaaacacacctccttaacccctgattcagtcgagggacagctcatcctaaaggagaagtttattacacaagcagctcctgatattagaaggaaactgcagaagcaggctataggaccagatagtaccttggagaacctgttgagggtagccagcttagttttttataatagggatcaggaggaggcccaagagaaaggaaggaagcacaagagaaggacagagactctagtagctgctttgcaggcttgcaaagtccaggatccccgaggtgcatatgctagttgctactaatgtgacaagtcggggcactttaagaaggagcgcccaggcagcaagaaaaaaccattttgatcctgtccagcctgaggcagggaccactggagaacggactgcccccagagacagaggtcaccaggttcagaaccagtttcatagatggtccaacaggactgatgggtcttggggttcaaacccccagatccagtagcttaaactaccattacagcacaggagccctgagtgattctggaaattgaaggaaggaaggaaggtggacctccttctggacactggagccagattctctcttctcttctctgatctaggcttcccctcttcccatagcataactgtaagcatctcaggaaaggttctgacctgatatttttctcaacctcttagttgtagttggggggatctattatttatgcacaccttcttaatcatagctgaaagtcccacctctttactaggtagagacatttcagctcgcatggggatcaacatcctcatagccccaggacaaacacttttctccccctggtggaaggtaatatgaatccaggattgtgggcaactcaaggaagaatagattgagctgtaactgctaagccagttcagttccaccttaaggatcccacttcttttcctaaccagagacaatatctcctaaagccagaggctagcaaagggctagaagcccttattaataacctgaagatgaggggcttcctcaagccctctaacagcccttgcaataccccaatattaggagtgcaaaaacccaatggggaatggagactggttctagacctctgcctcattaatgaggccatagtcccaattcatccagtggtccctaatccctatatcttgctgactcaaatacctgaaggaactaaatggttctcagtcctagatttaaaggatgcctttttctgtataccattacatcctgactcacaatacctatttaccttcaaagatccctccagccaaactgcccagttaacatggatggtggtgcctcagggatttcgagacagtcctcacttgtttggacaggcattgtcaaaggacctttctgagttttcccatcctcaggttaggatcttgcaatatgtagataacatattgctctgtaccccaattgaggaagcttctcaggaaggcactgaagctcttctgaatttcttagccaagagagggcataaggtttcaaactccaaggcccagctttgccaaacctcagtgaagtacctgggtttagtgtgtctgaagggaccagagcattaggggaagaaaggattaatcccatttcctccttccccctcccccaaccctcaggcaactaagaggatttcagggcattagaggattttgcagaccatggatacctgggtacactgagatagctcgccctttatatcacctcataaaagaaacttaagtggctaaagctcatctcctgacctgggaacctgaagctcaaaaggcatttagccagctaaatcaagccttacgtaaggcacctgccctcagccttcccacagggagggccttcaatctttatgtatcagaaaggagggaatggccctgggagttttaatgcaagcctaaggaccagctcaatagccagtggactacctgagtaaggaacttgattttgtggctaaaggatggccagtatgcctctgagcagttgctgctgtggccctactggtatcagatgccaccaaatcaaccctggcaaattacttaactatttatacccccacataatgtagcagaattgctgtcttctaggggaagcctttagctaacagacagctggctctttaaatatcaagctctgctgttagaagggtctacaatccaattgaaaacttgtcctcacctaaacccaaccactttcctccccgaggaaactggggaacctgaacatgactgtgagcaagttgtggtacagacctatgcagccagggaggatctcagggacactcccctacaaaatccaggctggacccttttcatagatggaagttcctttgtagagcaaggagtctgtaaggcaggatatgcagtcatcactctgaatggtgtttttaaagtgcatccctctctccaggcacaagcactcaactagctgaactaatagctcttataagagcacttgaattaaggaagggaacagtagctaatatttacactgcctccaagaatgcttccttagttctctatgcttatgctgccatttggaaggaaaaacactttcttactgctaatggatctcctataaaatatcatcaggaaattaacaggttattatcatcggttttccttccacaaggggtagcagcgatgcattgtaagggacatcagaagggaacagatgaagtagctgaaggaaacatgttagctcatcagacagccaagtcagtggcaaggaagcctcagggcacaacacacttgaagccgcttgaatttgggaaggctccgtaagagaaatgaagcctcagtactcccctgcagagatagaatgggccacctctcgaaggtacactttccagccctcaggaccgttgaagtcagaggatggaaaactccccttgccagccttcagccattggaaagcccttaaaatccttcaccaagcttttcacttgggaaaggatataactgatctgtgtgcccagagatcgttttcaggagagaacttattaaaaacagtcaaataggttgttaatgcttgtgaagtctgtcttaaaaacaatcccctcaacaggcagctccttcctcctcaaacccaaaggatgggaagctatcaaggggaagactggcagatagacttcacccatataccaaagatgaagggcatccaatacctcctagtatgggtagatactttcactaactgggtagaggcatttccatgccgtacagaaaaggcctctgaagtaataaaagggtgagttaacgaaataactcctcactctggtgtgcctaagtacctcaaaagtgacaatggcccctcatttaaggcagccatcacacaggcgttctcaaaggcactaggcatatggtatcatctccattgtgcttggagaccccagtcctcaggaaaggtagagatgaccaacgatgttatcaagacacatcagaaaactgtctcaagaaactcaccttccttgggtcactcttctttccatggctttactgcgggtaggaaataccccttcaaagttaggtctgagcccttttgaaatgctgtatggatggcctttccttaccagtgatttcttattagaccaggagacctctgaattggttaaggatgtaacttctctagctcattttcttttttttttttttgagacagagtctcactctgtcacccaggctggagtgcagtggcgcgacctcggctcactgcaagctctgcctcccggcttcacgtcattctcctgcctcagcctcctgagtagctgagactacaggcgcccgccaccatgcctggctaatttttttttgtatttttagtacagacggggtttcactgcgttagccaggatggtctcgatctcctgacctcgagatccgcccgcctcggcctcccaaagtgctgggattataggcgtgagccaccacgcccggcctctagctcactttcaacagcaatgaacacaactggcaaaagcccagccctcaaaaacaggagcacctctatttaacccagaggatttcgtcttggtgaaagctctcccttctctccctcctcccccacgcccaagctgggaagggccctattctgttcttcttatatttatttttatttttatttttttttgagacagagtttctctttggttgcccaggctggagtgcagtggcgtgatattggctcatcgcaacctccacctcccgggttcaagcgattctcctgactcagtctctggagtagctgggattacaggcatgtaccaccatgcctggctaattttgtatttttagtagagacagggtttctccatgttgatcaggctggtctcaaactcctgacctcaggtgatccacgtgcctcagcctcccaaagtgctgcgattacaagcgtaagccaccgcgcccagcctctacactgttcttcttttaaccccctcagcagtacaagttataggtattgactcctggatacatcacactcaagtcaaagcatgtaaagctaagaggcaacccctgacagcccagaggaacgtcctggatataaatgtgaagaaatagaagatgttaagctgaaaatcataacagataagtaaatgagtgagggcttctctacctactcagtcacacccctaccttaccatataccttcagtcatttctacttttcctctcgagatttgccatcaaatattaaaacatctttttgaaatgtactttcagagagattttgattatccaggggattacatttgtaacttcacagacccccagagggaaagtctatatcttggtgagtaaaattttagatggaaattatctactatacctcccttgcaggaattgttgtgctcactctacttgtagtaggactgtatactgtcacacccccagaatggaatattggatgaagaatctcaatcactgaagtattttgcttaattattatccttacagcagggacaatagttactgacgacaggtaaacatgaaggttttactatcactgagtcagctaggactttttctttttcttttttactttttttttctgagatggagtctcgctgtgtcgccaggctggagtgcagtggcacacaatcttggctcactgcaacctccgcctcccgggttcaagcaagtctcctgcctcagcctcccaagtagctgggactacaggcatgccccaccacgcctggctaatttttgtgtttttagtagagatgaggtttcaccatgttggccaggatggtctagatctcttgacctcgtgatctggccgcctcgctctcccagagtgctgggattacaggcgtgagccaccgtgcccggcctacctgtgcacttttaaatgaaacatgctgcttctggatcagcatctctagtcaagtagaagagaacctacaggtgcttaaagaccaaattagaatcattgacaagttaagagaaaacgtggattccagtcttctttatggaattgattagttccttttttaagcccgctcttgctcgtgtgttttgtactaatatttggaccttgtatacgcaatacggtaacttgaattatttcctctcacctagaagctattaaactccaaatggcgccgcggatggaacctcgcatggacatgccattcttccaaggacccttagatcgactccaggaggagctctagctgctgtgccccactcaatgcccctctcttcagcaggaagtagccagaaagtcattgcccaataccccctaacaggagttagggttaccactcctgagaggggaaatatgatacaggagctagaaagaaattatttggcagacagtgagggtgaataagtcctcagcaaggtttcccttttaagaaaacgcagcccccaaatcatttcttttctaacaaagagcagcctgaaaaattgagctgcaaacataggtaagcaagttggaagcttgcacggggggatgccggcacctgtgctgatagaagaaagctaccgggggccaggcatgttcaacatggaggctccatcttcccttttgtcaccatgtgtacagtaaaaaaagcaggcaacatggcaccggccaggtagagaatccatctgaataataaaagattagggtggggcggccagcttctttgtgcactatgcaaacagcacacctagtcctaaccagttctttgaatgctatgtaaacggcacaccttgtccaaccaatctttcattccctatgtaaattagacaccacctcctcaagcacatctataaaacctcctgcacttcactgcagaccagaagacctgcttgggacctcctctctcttcaggagagagcttttctctttctttcacctattaaacctccatttttaacctctctccttgtgtgtctgtccttgatttccttggcatgggacaaggaaccttgggttttaccccagatgaacgatgccacttcaccactatgttgcccaggctggtctccaactcctgggctcaagcaatgttcccgccttggcttcctgaattgttgggattacaggcgtaaaccgctgttcccagtctgaaaaattttcttcagagagaacaggctttgtcagtggtctacttgaacagtatactaaattcatcaggtttggggatccaaaggaactgtccattatcctcatccatcagcaaaaagaataggccctttggtaaattatttttgtaagtgcttaatcctcaattacttgttgctgggccttgtcatcaccaggaatcattccgtgctttgtgtccttaatgccagcattcacgatttaaaactaagctttctagcacttgcttcactgtttcaaccactttcttcctgggactttcaaattctttgactcctgtgttagttcaagtctacagaaaagtagatgtcaaggactacatgtgaaagaggtttattagagaaggaacagaaggcaggacaaatcttcagactgattgcaggtctgactatggaaggagagagggaaggaaggagggttgggtaggactggactgtagcaaaattcagccaggccacagggagtctttgagccaaaattgcctgttggaggtctgtatgtcaacagaatgggcattcccttaacgcacctcttttattaatctaatcatccgcagtccccattactctagtcctactgttgaaaatcatacaatagtagagaatactgaagccactgttaaaggccctccatagtatcccttcttaattccgattgtccacagcagttaccacgactcctcgtccttctcagctcctcttctattctgtctcaagtaacactgcttgtgttttctgagagaatatggcacctgtaggtcattaatttatctaaaaagaacacgtgtagtcaatttctttcatctaagctaagagcaaaatgtgctttaccagtcttaggaccccatcccttttcctacaaccatgttgatccctctgagctgtatttaaaaatactcctcagctgacttcattcttacactctagttccttttttttttttttttgagacagtctcactctgttacccaggctggagtgcagtggcacgatcactgctcactgcaacttccgcctcctggcatcaagcgaccctcctgcctcaaccttccaagtagctgggattacaggcatgcaccaccatgcctgggtaattttttgtatttttagtaaagatggggtttcgccgtgttggacaggctggtctcgaacttctgacctcaggtgatctgcccgcctcggcctcccaaagtgctggggttacaggcgcgcgccaccatgcctggcccaccctaggaactttttttttgtttgatgggtcttgctttgttacccaggctgcaatgcagggggttcttcacaggtacaataaataatagctccctgcagcctcgaactcttgggctgaagtgatcctctcacctcagcctccgaagttgctgggactacaggaacctgccaccatgcccagctgttttataaaatatttttagaaatgggggtttcaccatgttgcccccaggctagacccatgggctcagttgtcctccctcctccacctcctgagtagctgggactacaggtgcacaccaccattcctggcaagaaaacattcttttttttttttttttttttccgagactgagtcttgctctgtcacccaggctggagtgcagtggtatgatctcggctcactgcaacctctgcctcccaggtccaagcgattctcctgcctcagcctccagagtaactgggattacaggtgcccaccaccacaccaggctaatttttgtacttttagtagagatggggtttcaccgtgttggccaggctggtctcgaactcctgacttcgtgatccgcccgccttggcctcccaaagtgctgggattacaggcgtgagccgctgtgcctggccaagaaaatattcttaattccatttaggttcacataaattccatttaggttcatatccaacttcagatgaattttcttgatagaacaaatgtgcagacttttcagtaatacagactgaattattcaccaaaactatattgacgctacatgacagaactaaaaaggagtaaattagggtcagtttaatgtttcattaggtatttagagaccaaaagaaaccacaaaatcttcttatttaaaatattttaatttctaaaaagcttaaatcatattaaaatttaaacaatttcattgtacagtacttgacaatacatttcaacaaactgaaaggcaaaccagtaaatcagttttgcttactttctaagcttaataatgtacagactcttgctcttcaagaagatgcaaaaatcagcaacagtacaagtgaaatatttaaataggaatctgaaacaaaacgaattcaatctgatcaaatccacaattaattgaagttttcattttattcaattgtgaataaaatagcagacactgtttcatccaataagccaatgatatcagcttaggagaaatgatctgcctggcttgtgcaagacaagaacagttaccttctgctgaaaggatgtgagttttcaaatttggttttcatgtcatagtttccaaataaatgaaccgctccaccaaaaacgacagtctagttgctacctatcttccagggtttcatcatacagccatttataagcacaatctttggaacgctctatagtttcaaaaagtgttttgaagtcttgagggtgcatgttaactactttctcatcctcctgttttcctatttgcatcaatatatctctcgcatcaagtggagtcaatgaactgcaaaagaaatacaaagtaaatgtacttaattctttctcatgcatctatcagttcacggtgacagaaatggcttctaagttgaattcaaaatgtctaacttaggcatacagagtgctataatggacacgggagaatcagcagggaagaggatgggaggagggtgaaggatgggaggagggtgaaggataaaaagctacctactgggtacaatgtacactatttgggcatgggtacactaaaagcccagacttcaacaatccatccatgaaaccaaaaaaatcacttgtattcctaaggctattgaaataagaagaaaaaaaaaagcctaacttattatatataagcaatcttatttagtttaagagcttccagtaactttatgcttatttctaaagtttcatagctaacctataatgaaaatattaatagcaggtttaggctttcacatactctaatcaatttttacaccgaattctagtttaatcactgccgtttgaaaaaattattatgcctacctctttcatccttttcctttctgcaaaaaatattcttaacttcttttggttcatgtcaaagttcagtaactataaacagcagaagttgctgtttggcagtttacaaagagggaatcatttttcacattttgatgtaaccatcattggtaaatacattataaagccgcaaacttccttatacagtcatgcattgcttaatgatggaggtatgtcctgagaaatgcactgttaggtgatttcattgttgcttgaacatcttacagagtacttaacccaaacctatgtgatatagcctattacagacttaggatatatggcatagcctattgctccaaggatacaaacctgcacagcatgttactgtactgaatactgtaggcaactgtaacacaatggtaagtaatagaaaagatacagtaaaagatacagcatctttataatcttatgggaccactattgtacatttggtccactactgactgaaacgaggtataacgaacacgcctcattatgaggtattatatatataaggtatattatataatatatatacaatatataatcaatgaggtatattatataccataatatgaggtacataactgtgtatcagcttagcaacaaaccatcaataagcctccaacaacaacaattgtaaaaaaatattttgggctgggtgcggtggctcctacctgttatcccagcactttggggggctaggtgggaggatcatttgagcccaagagttcaagactatcctgagcaacatagtgagaccccatctctacaaaaatcgtaaaaagttagctgggcatagtggtgggcatagtagtcccagctactcagggaagaggctgaggcaggatcacttgagcaaggggtttgtggttgcagtgagctatgattgtgccactgtactccagactgggcaacagagtgagactctctgtctgttcaattccaatactttttgatattgaatagaatcttggtaacatgtttctagtccactgagattaccaggagcatttttaatattttgcactatgatttacaacatttattccttatttccctattttcttgatattttcattcaaaatagccacaaggtggcaagatgaaaaataatagattgccttttattagtctattgccttttactagtctattaccacttttttttttttttttttttagagatagagtcttgctctgtcacccaggctcatctcaaagtcttgttggcgctctctgcctcccaattttttttttttttttttttttagagacaaggtcagcttgctctgtgtcccacactgcaatgcagtggtgagtttatggctcactacagcctccaatccccggcctcctcaagtgatcctcccaccttggcctcacaaaaatgctcggattacaggcatgaaccactgcacccaggctattgccacttttaacatttatttttagataaatattgtctagtcaacagctcattcagagttaaatattaaatgatcaaatttgttaaaataattattttaacattttacccatcctctggcgagactttgaatgactatgggctgctgattacaaggcataatgcacaacttacagggacgtatgcatcagccctacatacaaattacatggatttatgtacaaattacacagatggctgggcgcgggagctcatgcctgtaaccccaacactacttacagagatgtatgcatcatccctacatacaaattacatagatggccaggcgcagtggctcatgctggtaacctgagctgtacttacagaagtgtgggcatcaggcctacacacaaattacatggatggccaggcatggtggctcccgcctgtaaccccagcactacttacagaggtgtgtgcatcagccctacatacaaattacatggatggccaggtgcagtggctcatgcctgtaaccccagcactttgggaggccaagcaaggtggattgcttgaggccaggaatttgagaccagcctgggcaaggtggcaaaaccccatctctacaaaaattggcatacaatttataaacacaaaatataaatataaaaattttatatttttacaaatataaaaattagccgggcgtggtggtgcatgcttgtagtcccagctactcaggaggctgaggtgggaggatcacttgagcctgggaggacaaggctgcagtgagctgagactgtgccactacacttcagcctggacaacacagcgagaccctgtctctaacaacaacaaaaaaatgtttttcacttatatagacataaagcaagtagtgttacttacaagctattatttttacaaagctttgggtaaaaacaaaatttgatccagagcaagggaaccagggtggtataattatctatccctactctggttaaggaacagaaccactgaagacaagcaatgagaggtaagtgtgggcacgcctccagtaatgctgatttctctccaccccactagtggtaggcagctagtgcttcctgtaagataaagctaagcccatactctcaaaaagattaaacaatctgggcatttttttaaagaaggaaaaataaatgaaactcaatgagagattatgggaaaaatatattttcctcaaaatgtacaccagggagaacaaattattttgaagaaatatgagggaaaacatggtacctcactctgtcaatcaagatataaaaatagatctctagcatgaaagaataatttgtgcatcgttgctactttatacttgcttttattctttttactcaccgtaagtggtctattacagtggcgctgcgcctcccaaaacagtgctttaacaagtgaaaaaatatattatagttcataggtgttaagttcttggtaaataaattttgacgaggaatcatttgaataagatacagcttttgttgtaattggtctaataattcctggagagaagaaaaaatgaattgcattagtcacaaaatattgccagagtaagacattgctcacttcttccttcaagctatctgctgaaagacacaatcaccacaggccctgagtgtcttcacattctctttttctttcttggagatagagtctcactctgtcgcccaggctggagtacaacggcgtgatctccactcactgaaagctccatctcccgggttcatgccattctcctgcctcagcctcccgagtagctgggactacaggcgcccaccaccacgcctggctaattttttgtatttttagtagagatggggtttcaccgtgttagccaggatggtctcgatctcctgacctcgtgatccgcccgcctcggcctccccaaagtgctgggattacaggcgtgagccaccgtgcccggcccacattttcttattgtgtacaccaagaacacaaagccctaattggtctttaccaatgaattgggccatttctcagagttgtttgtgatgagtaaccttgagggaggagataacgtctctctccaggacaaagagcaggcctgtggctgggtgcagtggctcatgcccatgatcccagcactttgggaggccaaggcgtggatcactcgaggtcaggagttcaagaccagcctggacaacgtggcaaaaccccatctctataaaaaataaattagctgggtgtggtggtgtgtgcctgtagtcccagctactcgggaggctgaggtgggaggatggcttgagcccaggaggtggaggctgagagcatgccactgcactcaaggctggttgacagagccaggccttctcttaaaaaaacaaaagggcaggcttgcttaatgtttgctatgaaggaggaggattcattgggaggctgaggtgggcagatcgcttgagcccaggagttcaagactagcctggacaacatggcgaaaccctgtctctacaaacagtacaaaaattggcagggtatggtggtgcatgcctgtagccccagctacttaggaggctcagatgggaggatgcttgagactgctgcgtggagtttgcagtgagccgagattacgccattgcactccagcccgggtgacagagcaagaccctgattcgaaaaaaaaaaaaaaaaaaaaaagacctagattcccccagctctgtacttctcagctgcaaagcaagtccactaaatgcaaggcacccaactgagccacctcacatcactccatgggaagagaggcacagaacatcctctgtctgatccaggagtcttaggccaacatccgagaaacagtaacatttattaacatgtaagtagggtaaaatcaaatcccagacatgaggccgggttgctcacacctacaatccaacactttgggaggccgaggcaggaggatcgctggagcccaagagttagcgaccagcctgggcaacacagggagactccttctttacaaacaaacaaactagctgggcgtgggatgcacatctgtggtcccagctatttgggaggttgaggtgggaggatcacttgagtcccgggagtttgaggctgcagtaagccgtgattatgccactgcactccagcctgggagaagagtgagacactgtcttttaaaaaaagaaaaaaaaataggctgggcgtggcggctcacgcctgtaatcccagcactttgggaagccaaggtaggcggatcacctgaggtcaggagtttgagaccagcctggccaacgtggttgaaaccccatctttactaaaaatacaaaaattagccctgcgtggtggagcatgcctgtaatcccagcattcgggagggtgaggcaggagaaacacttgaactcgggaggtaggggttgcaatgagccaagatcatgccatcgcactccagcctgggtgacagaatgagactttgcctcaaaaaaataaataaataaaaaataaaaaaaggaaaaaaaaaaaaacccaaacatggcattaacatatattgagtccttgctatattcaagataaaacatcaccatcggatccaaaggacaaaaaaagttattgactaaaatttttaatcggatatttaaaaagtaggtctcaaacaaaacttggatagaaatgacaggccctaaaaacctgttaaatgtctcaaactgcttccatagcaatatgagcaccttgatatcaaagacacatgtgaaatatctaaaataaattctgtcataaaatatgacatttgcttatttcatcttcatccctaaaagtttatatatgtatatatacacacacacacacacattttttttttttttttttgagacaaagtctcactctgttatccaggctggagtgcaatggcatagtctcagctcactgcaaactctgcctcccaggttcaactgattctcccacctcagcctcctgagtagctgggactacaggcgcacgccaccacacccagctaattcttgtatttttagcagagatggggtttcagcacgttggccaggctggtctcagactcttgacctcgtgatccacccacctcggcctcccaaagtgctgggattacaggtgtgagccaccacgtccggccaagtttatatttttaagttggccaaaaaaacttaagcttttcagcttcttgctgaaaaactgagaaagtatattatatacaggattgttcatttgtggaatatttggataagtccccaatagtatccaaatgtactgtattagacaaaatgcattattcctattctgttttttgggactacataaatatgctgtataaatagtcaaacagaactaaaagcacaatgatgactgatcactctaaaatcacaacattgaaagaaaactgataattttctttttcctttagtggcaagtgtgagaaaaaaacataagtaagcaaacaaacaagatcttcagactaagctgttatgctgagattaggccattgttagcatttaattcgttttttttttttttaagccccaaaccttaaagacaggcatctaattctaaagtgaaacttctgaattgagtcaaaaaattgttttgtgaaactttagctactttattagaatttcacaactagccctgagataaactaaatggaggactataacattgtcactttggttcttacgtacaaagattaaaaaatgaacaaaaataaaggcctaactcctgggtaaaaatcaagaagtacctatcagtgaattcaaccatgtaataagagtagtaatatcacaatttttttttttttttttttgagacagagtctcgctctgttgtcaggctagagtgcagtggcacgatcttggctcactgcaacctctgtctgccaggttcaagtgattcttctgcttcagcgtcctgaatagctggaattacaggcatgcgccaccacacccagctaagttttgtatttttaatagaggcggggtttcaccatgttggccagggtggtcccgatctcttgaccttgaatatcacaaatttctaatcgattaatacgtcataaaattttgtttctaattaatcgaattagataaatattaaaatgattttattttccaaatttgaaatgtaccttcatttcaaaagatataagaagagaactcagattctgtttttaagcctattactatgctagcatccattgtataacagctgataactcttccaaaatacttttgattcattaaaagtagtaagatatgtttaaagaatgtttctagatattttaaaattaaaaagttaaatacagactaccaaatagtcctaaaaaaataaaataaaaaatacgtcacgtagggagaaaaaggaaaaggtattattttattcttaccctacgctttgggttttccagcggccctttccgggtgtatatatcaaatgatgaccaaggctcctggggaagaaaaacaaagcaaaacaacatcttttatttctctttggtcaaagtgccccagttattacttccttaaaaaacaccttgcctaaataagagaatggtcagtctaattggatttaaaagaaacatgttatagctaaataatacacatctctctccttaatttttttaaagaggaggaggatcaaaagtctacccaaatactagtacctcttttccttattaaacatgacttcgcctgttatgcaattacgcaaataagtatttgttataatttttaccactcaatatttccatatcacagtcagaatcagcagtttaagggatattagattaatgctgaggatttctttttgccctacttcagtggaaaagcctactaatcaaactatttgaatatgttagaacatatatggaaataaacaaataaagatactagtgtcgaccaggtgctgtggttcatgcctataatcccagcactttgggaggccaaagtgggagggttgcttgagcctgggagctggagtttgcagtaagccactgtactccagcctgggaaacagagtgagaccctatccaaaaacaacaataacaaaaacctagtgtcaattttaaaatggatcactatttttcggtatctatcttttgtaagagaattttgtgcataaggcaattttaagagatgatccggtcaggcacagtggctcatgcctgtaatcccagcactttgggaggctgagggaggaggaccgcttgagctcaggggttcaaggccagcctgggcaacatggtgaaaccctgtctcttcaacaaatacaaaaattagctgggtgtggtggtgtatgcctgcagtcccagctctttgggaggctgaggcgggaggattgcttaagcctgggaggcggaggttgcagtgagccgggattgtgctggtgcactccaacctgggctgacagagtgagatcgtgtctcaaaataaaaaaccgacccacctgaaaaagtattctctattaaaaaaactatacatacccataaccatattaaattccaaaataagagtgggttaaaatagatctgacataggcttaaaagactaaacaatattgaacacaaggtctgaaaggctactgtcaagtaacaatttattattaactgcaggggcaatgagagtggctaaaacatataattgtggccaaattgtgaaattcctagcagttccaggaatgtcactttaagtgggggaagaaaagcaccatcagccgtgcacaatgagtactgccacttcccacacgcctggtcgagcctcaacagctttcccctcatcaagcacagtggaggaaaacctgcaagacactgggaattgacttcaacaacttactctacagatgtagacacacagtggagcaagtgctgagaaacgttaggtccagaaagacctttcctttctggagtttagtaaatggcaaaacctaacacgggacctttgaaagcaaatactaagggaacaagaagacgaaaacattctgcaagctaaagtcctcagagggcctctctgaagaaactagctgaaagctaccaggacagaagacttgagatgaaagtcaacagaatgagacaagatcagtgggtaaggaagaattttagagaaaccaagaactatagtactgagagtacaatatacagtgcaggcagaaagcagaatcagtgatgtgaagactaagtgtgaagagattctgggaatggagaaaaatgatgagagcatgacagacacgaaagacaaggatcagagatccaacctaagaacctcaaatgtttttgaggggaaaaaaaaagaattggaacaaaagctaaaatcaaatgagataacattcctgagcttaaaaaaaaaatacagcaaggtgcagactgaagacctcagcatattctcaggcggaagcagtgacgagaacacgtgaagatccacattgtaaatatttaaaaattagagccagggccaggcgcagtggctcacgcctgtaatcccagcactttaagaggctgaggcgggtagatcacctgaggtcaggagctcaaggccagcctggccaatgtggtgaaacctgtctctaccgaaaatacaaaaattagcaaggtgtggcggtgcacgcctgtagtcccagctactcgggaggccgaggcaggggaattgcttgaatacaggatgtagaggttgcagtgagccgagatcgaaccactgctccccagcctgggtgacttgagtgagactccatctcaaaaaataaaaaaataaaaaatagagccaggtgcagtgggtcatgcctgtaatcccagtgatctgggaggctaaggcagaaggatcacttgaggccaggagttcaagaccaggctgggcaatattcttaaacattttaaaacttagccaggcatggtggcgcctggctgtagtcccagctactccagaggctaaggtgagaggatcacttgagtccagtagttcaaggctgcagcaagctatgattgtgccactgcactccagcctgggcaacataatgagaccctgtcgctaaagaaaaacgtttttaaacagaaggattttactcaccatgtgcagaaccttaatctcacaagctaattgccagataacacttaatacatgatacaagtctggatttccgggatctgccattagtttctagtaaaaggaaaataaaaattacatgttatacacatctataatcaattaaaaacaaatgctgactcttaataggactatcttaatggcatctagacatttaagaaaagaaaactagaattagatgcaaaaagccgggtgcagcggtgcacgcctgtagtcccagctactcgaaaggctgaggcaaggggactgcttgagcccaggcatttgggcgttccgtgtgagatgatcgtgcctgtgaatagccacagcactccggcaggggcaacggcagggcacgcggggtcacgcttgtaattccagcactttgggaggccaaggtgggaggatgcttgagcctagaagttcaagaccagcctgggcaacatagtgagaccgcatctcttaaaaaacaacaacacacaagtgttaaggctgacttgaaaggacgaggttacctcaacgaatgggaaggcactccgcagacaagaaaccacatgtgaaaaggtccacggcaaaagaggcatgggccagtggaatataaccctagcagcaggaatctaacacagcacttcctattcttctccttgtctttcctttgttgaatagcgtatgcacagccccaaggtcctgaggccctcgctgtctttccatggctagcaaatatgtatttactaaatgggtctgggggagcaaatcatcccttcattttttgccccactatcctaatccatagcaatacaaataagcattataaaaatcttaatcttctttgagtcttaatagtactatcttaatagcatctagaaatttaagcagagaaaactagaattagatacaaaaagctgggtgcagtggtgtgcacatgtagtcccagctactcgaaaggctgaggcaaggggactgcttgagtctaggagtttgggggttcagtgtgagatgaccgtgcctgtgaaaagccatagcactccagcatgggcaacacagcaagacaaacaagcatttcccgtcaaactggattaacagatcaataacatgaaacattctgggcagaaaagaaagatgacactcatagcgagatcaaggttgtcaggaagaccttccattacagagaattgaactagagtctcaaatcttaggctcggtgtaatggctcacaactgtaatcctagcactttgggaggccgaggcaggagaatcacttgaagacaggagttcaagaccaccctgaacaacacagcatgaccctgtcactacaaaaataaactacctgggtgtggtggtgtgcacaggtggtcccagctacagggaggctgaggcaggagtgtcacttgagcccaggagtttgaggctgcagtgagctatgaacataccacgacattcaagcctgggcaacagagcaagaccctgtctctaaaaaaatttcttttaatgttttaaagttaaaaaaaataattataataccccttaaatattaaaaaaaaatcctgttaaaactaataaattcagctgagtatggtagctcacacttgtaatcccagcattttgggaggccgagggaggaggatcacttaagcccaggtgtttgagaccagcctgggcaacaaagtgagacactgtctctatttaaaaacaaagggagggaaaaaaaacctggctgggcgctgtggctcatacctgtaatcccagcactttgggaggctgaggcaggcggatcatgaggtcaccagtttgagactagcctgaccaacatggtgaaaccccatctgtactaaaaatacaaaaaaagtagctgggcatggtggcgcgtgcctgtaatcccagctattcaggaggctgaggcaggagaatcacttaaactgggaggcggaggttgcagtgagccgggattgcgccactgcactccagcctgggcgacagagcaagactccgtctaaaaaaaacaaaacaaaacaaaaaacctaataaattcagcaaagctgcaggatacaaaaatcagttgcatttttatgcactaccaacggacaattcgaaaaacaattccatttacaatagcaccaaaagtaacttaaaagctagtaattaaaaacacaaataaatggaggccaggcacagtggctcacacctgcaatcccagcacctcaggagactgaggtagaaggatcacttgaacccagaagttcaagaccagcctgagcaacgtggtaaaaccatctctacaaaaaagacaataatcagccaggcacgggggtgcacgcctgtagtcccacctactggggaggttgaggtggaagcatcacctgagcctgggaggtcaaggcttcagtgagctgtgatcctgccactgcactccagcctgggcgacagtgagaccctgtgtcaaacaaaaatgaaaacaacaacaacaacaaaacccacaaataaatggaaagacatttcatgttcgtggattggaagatttaatattgaatactgttaagatgccactaccacccaaagcaatctccagattcaacgcaatccctaggaaaatcctaacgcattttggagaaacagaaaaatccagcctaaaatccatatagaatctcgaggaaactcaaatagcctaaacaatcattaaaaagaataaatttggatgaatcagcccctgatttcaaaacttaccaaggtaacagtagcaacacagtgttgtcttggcctaaggacaaatatttagatcaatagaatacaatagagcccagaaataaacgcgtacacatatggtcaaatcatttctgacaccaacgccaaagccatttaatggcagtaaagaacagtctttccacaaacggtgctgggaaaactagatcaaagaatgaagctggacactgaaaccataagcaaaatttactgaaaatggatcaaagacctaaacaagagccaaaactataaaactcttagaagaaaacacaaggaaaccttcacaacactggatttggcaatgatctattagctacgacacaggtccccaatccccgggccacgaactgataccagtccgtgtcctgttagaaactgggccacacagcaggaagtgagcggcaggtgaacaggcgaggcgtcatccgtatttatagccgctccccaccgttcacatcaccgcctgagctccacctcctctcagatcagcagccgccttagattctcataggaacacaatccctattgcgcatgcgaaggatctgggttttgcaagggccttatgagaatctaatcccgatgatctgtcactatctcctgtcacccgcaagtaggaccatctagtttcaggaaaactagctcagtgttcccactgattctacattatggtgagttgtataattatttcattatatattacaatgtaataataatagaaataaagtgcacaataaatgtgatgcacttgaatcatcctgaaaccatccccgccgccatccacgtaaaaactgtcttccacaaaactggtccctggtgccaaagatgttggggaccgcccagctacgtatgataccaaaggcacaggcaacaaaagagaaaaaaagacaaagttgacttcatcaaaatgaaaaactttgggcatcaaaggacacaattaacagggttaaaaggcaacccatagaatgggagaaaatatttgtaaatcatgtatgataagagattaatatccagaatatataaagaactcttaaaactcagcaacaaacaaaataacccattaaaaatgggcaaatgtcttgaacagacatttcttaaaagatatacagtcagtacgtacataaaaatatattcaacatgactaattattaggaaaatgcaaatcaaaagcacaatgaaataccacttcataccattaggagaggtattaccaaaaacccagaaaacgactctcagtaatgctgtggagaaatcggaacccttgtgcactgctggtaggaatatcaaatggtgcatccacgacggataacaaacagtatggcagttcctcaaaaaactaaaaatagactgggtacagtggctcatgcctgtagtcccaacactttaggaggctgaggcaggaggactgcttgagtcccagagttggaggccagcctgagcaacatggcaagaccctatcgctacaaaaagctgggcctggtggtgtgtggctgcagtcccagcttgggggctgaggcgggaagatcgcttgagcccaggaggtccaggttgcagagagctgtgatcatgtcactgcactccagcctgggcaacagggcaagaccctgtctcaaaaaacaaacaaacaatcaaacaaaaaacaaaaaacccacaaaaaactaaaaatagaattactatatgatcctgcaattctacttctagctgtacactcaaaggacttgaagagatattggtaaactcatgttcattgcagcattattcccaacagccaaaaggtaaaagcaaccaaatgtcattgatacatcaacacacaaactgtagtatatatatacaatagattttttttttgagacaaagtcttgctctgttgcccaggctggagtgcaggggcatgatctgggcttatagcaacctcctcctcccaggttcaagtgattctcctgttttagcctcccaagtagctgggattacaggcatgcaccaccacgcctggctaatttttgtatttttagtagagacagggttttgccatgttagccaaactggtctcgaactcctgacctcaagcgatcagcatgccttggcctcccagagtgctgggattacaggagtgagccaccgtgcccggccagaatggaatattattcagccttaaagaggaatgaaattctgacacatgctataacattgatgaaccttgaaaacattatgctaagtgaaatacgccagacacaaagaaatattgtagagtaaacttacatgaggtaaagagaatagtctaattcatagagacagaaagtagaataatgattactaggggacgcaggaagagggaaacgagagtttgtgtttaatgagtacagagttttggtatgggatgatgaaaagttttggagacagatgatggtaatggctgtacaatgggaatgcagttaaaaccactcaactgtacactgaaaaagcaacctgagcataagactgctctgcagaatttaaaaacaatcttagaccctcaaatgtcacgagccctaaattaaaatcgcacagattaagagtactcagagaaaaattacagactcagaacaaaaaataggtatttgttaataacatacctggaattctttttcaccaataaacatatttacttctattcgtccaaatttatatatagaagtacaggaatacaagtcatatgcgagtttccaaagtgcccttttctcacctctacttgggaacattccaactacttttaaagggatgtctgttaggaatataagcaaaaagatttgaataaagttcttagcattttgtcctatgtccatatttttttgagacaaactaagttaacaaactatattaatttcaagtttatttcaattaaaactaagcctcaatatctttccttggcatgaaacttggcttttggggaaataaactgggtacctgtgtccaggtgaggtaaatgccatattcagagtcagagcatctgctcataaactgtattaatataatataaattatacacaaattcggcggggtacggtggctcacatctgtaatcccagcactttgggaggtcgaagcgggcagatcacttgagggctggagtttgagaccagcctggccaacatggtgaaaccccgtctctaccaaaaatacaaaaaaataaccaggtgtggtgacacacacttgtaatcccagctactagggaggctgaagcaggagaatcacatgaacctggaggcagagggtcagtgaaccaggatcgcgccactgcactccagcctgggtgacagagtgagactccatctcagaaaacaaacaaataaataaaacacaaatttcatcaacaaatcagttatactgctagagacacctggcaaattctaggtatttgctttagtaaattccaaaaatgacctgctgtccaaggaactgcttctattcccaaattcttaaagagccctcgagaagacatagcaggtggttttattactccaccacttctaggatctagtttaaagaagtcacagtggatcactcgtagttttccatccagattttttcctaaggactaaagagagacaaagataacacgttaaaaattttcagcattaagtatactttgcagcaattcaaaaaactctacttcaaaaaaccataataaaatgtaaaaataaaaataattcaattacctggggtttttttgttttgttttgttttgtttttgagagacagagtctcgctctgttgccaggctggagtgcagtggcgccatctcggctcactgcaacctctgcctcctgggttcaagtgatcctgtgccagcctcccaagtagctgggactacaggtgcgtgccaccacacccagccagttttttgtatttttagtagagatggggtttcaccatgttggccaggagagcctcaatctcttgacctcatgatacgtccaccttggcctcccaaagtgctgggattacaggcgtgagccaccacgcccggctgaattacctttttacaaaaaatatttctacctccataactatgtaaagaaaatattactaacatacccaaaatttaacagaggaagtaaaaatcaattaatacctgaaaagtggcaaaagtacaatattaccaagaaaaagccccccaaacagaaataaactatcataaatttttctttatctgtttactttttttttttttttgagacaagctgtcaaccaggcaggagtgcagtggcgcaatcccagctgactgcagccttgacctcctgggcttaagtgatccttccacctcagtcccacaagcagctaggactacaggtgcataccatcacgccccaccaatttttggattttttgtagcaacagggttttgccatgttgcccaggttggtctcaaactcctgagctcaagagatctgcccaccttgacctcccaaagtgctgggattacaggtgtgagccactgcacccggccccacttactttctttatcataatggcttcagctattcaaaagcttttcacaccactccctgcctgcttagtagtggttacctgaagcactgggcaaagattctgacaccatggttggcctcttacagagaactgtgagccatctgctttggtcatgggaagaaaaaatgaaagatgtttcacagtaaagaaaaacaattaaaatataaaagtgaaaggcagatggattcaagagaatatctttcttctaggggaatctagtcagctatccaccaaataaatgaacttagctcatctccataattttcatttactttttctaaagacagaagcaactatacaccttgtttgctggaagaggtctaatatatctcagtcttctcactgctctgatttgctcatcttgcagtagtactagagaccttcatagttagggcaagaatcagttatagactccataaacttaattcgaagttacaaaaaaaaaaatcagtaagaaggcattatgtttttaatgtgtacactgatgtttctgtgcacagaaaattctattaatatttattaaggttggaaatgatgtaacttaaagttattaatgcaaacacctattttttcttaagcatttgtattcaacctatattatcctatttctaaatctagtaaaatactttttcttcttattttttattgagatgagtctcactatgtccccaggctggtctccaactcctggccttaagtgatgctcctgtctcagcctcctaagtgtctgggattacaggtgtgtgataccgtgtccagctcaaaatgtagtaaattttggccgggtgcagtggctcacacgtgtaataccagcactttgggaggccaaagagggcggatcacacaaggtcaggagtttgagatgagcacggccaacatggtgaaaccctgtctctactaaaaatacaaaagtaagccaggggtggtggcacacccctgtaactccagctattggggaggtgaagtgggagaaatcgcttgaacccaggaggcaggggttgcagagagctgagattgcaccactgcactctagtcagggtgacagagtgagactccatctccaaagtaaataaacaaacaaatctagtacattttaacaatcactttcaaggggaagttttaaaaagactagaggaagggaaagactgggggtggaaatcatacacatttggtcacattaatttcgagatgcctactatgtgatctaggtagaggtgccaggtaggaagttgcagacctgaataaggtgctcagtggagtggtccagtctgacgatataaatgtgtgggaatttggcttgttgaaggtaatttaagtcaggggtctacactagggagaaacagaggactagccctgaaggtagagtatgtccaaagtctaatgacaagaaactgagaatacaactaaggaggaaaaccagaagagtgtggtgtcatggaagctaaaagaaagagtacctacctaatgcatacgattgtcagtcaacacgcatggcaaggctgtctaacctgtggcctgagggccgcatacagcccaggacggctttgaatgtggcccaacacacatttgtcatctttcttaaaacattatgagatgtatgcatggactttttttttttttaagctcatcagccactgttcttattactgtattttatgtatggcccagacagttgatgtttcagggtggcctaggcaaaccaaaagattggacacccctgatatagcattaacataatctttcaagttatcaaaaaggcagtttaatctttgtaattaaggaaagctaaacagcacaggtgtggtggctcatgcttgtagtcccaggagtttgagaccagcctggacaacatgacaaaaccctgtctctactaataatacaaaaaatcagccaggtgtgggggcgtgtgcctgtaatcccagttgcttgggaggctgaggtgggagaatcacctgagcctgggaagttgagactgtagtgagctgtgactgcagcactgcactccagcctgggcaatgggagtgagaccctgtctcaaaaaagaaaaagaaaatgtataaacaatgaacactttatggcctcaatacacttgtatgttctgagagggcaccatacattcttgctttagcacttgtcagttaacactcaacaattcaaacatgataataatcaaagcttcaggataaataattcaattcatacaacagatcacatttaaaaattcaactggattgcattaggattcaaaaacagaatgggaaaaaacagagaaaaggcaagtaacccttgagtttttactagtcattaagttaggtacttaagttagtcattaagtttgtctcatttactgggtgcagtgggtcaagcctgtaatcctagcactttggaggctgaggcgggcggatcacgaggtcaggagttccagaccagtctggccaacatggtaaaaccacgtctctactaaaaatacaaaaaattcgtcggtcgtggtggcggtcacctgtaatcccagctctcaccactgaaactcctttcagttttcaggaacaaactttaggtggccagaagcattatccgctaagcgcagcactttaagtccctgacttagagccacaagagttctgcttacctattgttacttctcttttcactctggcaaacagattaattcacacaaaattttatttgaatggcttttcaatttatcataacaatggttactaaaaagtgagagaatatgtactaagggttgagtacaagtcagtgctagtagaaaataagagccttaatagagaaaaaactagttctaatcaaagactggatttagtcaatgatgtttatatttttagctgacatttatagcttcagaaacattttgttattgatattcctatcataattattgtttcaaaaattctctagtccctaaccttccttttttcattaaacaattgttttaaaattaaactgttatcttgaaggttttttttttcttttgagactgagttttgctcctgtagcccaggctggagtgtaatggcacgatctcggctcactgcaacctccacctaccgggttcaagtgattctcctgcctcagcctcccaagtaactgggattacaggcatgaaccaccatgcccagctaattttttgtatttttagtagagatggggtttcactatgttggccaggctggtcttgaactcctgacctcaagtgacctgcccgccttggcctcccaaagtgctgggattacaggcatgggcctcggtcctcagccttgaagatcttatagaaaaaagcaactactgtgttacagaataacaaactttaaatagaaacaaagacattttaatacaatcttaattactttgtgaatatgtagattaacctttaaatataggcttttttttttcctcaaatcaggataaaagttatcttctcatttttaatttccaagttgaaactacagatgactatgtttactgaatcacatttcaggatcttaaatcttcggacaattatgtgttttttcttcacatttttggaactccctcagatttaacatcaattaaataacctagctaaaaccttgaactcttttcaaaacagtaagtggtagaataacaataatttcatactcatagttttaaaagaattaaacaactggatttgacagacattttcacaattttttgttgtcatgcaattttggatacagccattctgcatggtttcacaaagttggcatagagaaatataagtttcctaagttgaaacggaagattataaaagagggaaggagaatgagagtaagagactggttaaagacccaaaggatttccacttcttcattgttacgtaaatgtgtctgctttttaagaagcacaatcactgaaaaatctatttggatgatgccttcactctatgcaactgtatctgactacaggctgagcatccttaatccaaaaattctgaaatgctccaaaatgtgaaactttttgagtgtcaacatgaagccaaaagtggaaaatttgacacccgaccttctgtgacaggcttgcagtgaaaatgcaggtatacaacacgaagatgaggtcagtctataaaaatcgaagggagtcatctaagacaaaaaccactgttaataaggcagatgactccatagggaacttttttttttttttgagacaaagagtgtagctcagtcgcccaggctgcagtgcagtggtgtgatctcagctcactgcaatctctgagtcccgggttcaagcgattctcctgcctcagcctcccgagtagctgggactacaggcatgcgccaccacgcccagctaagttttgtatttttagtagagacggggtttcaccatgttggtcaggatggtctcaatctcttaacctagtgatccgcccgcctctgcctcccgaagtgctgggatgacaggtgtgagccaccgcgcccggcccacaggaaacatttttaaaagccggccggcagaatgtctccttagccttgacggacccgcttcctggtccctcagctgcttctgatgtttcttcttaagaaaaaataaaatgtggtgtacagtaacctttcaatgaaaacacagcatcccaggagactgaaagcctgccgctgtgtgtttccactgttcaacagctgacacagggattctgatgctgctgtgctgcttagtttctctgaacacactttttttttttttttttactgtactaatggtatgtcattttttctactgttaagcactcatgtgtgaataagtgtaagaaaatgatggcttatcagaagcatataaattcggagtcaggagctaggcatggtggctcacgcctgtaatcccagcactttgggaggccaaggtgggtggatcacctgaggtcagcagttcaagaccagcctggccaacatggtgaaaccccgtcactactaaaaatacaaaagtcagctgggcatagtggcgggcgcctgtaatcccagctacttgggaggctgaggcaggagaatcgcttaaacttgggaggcagtggttacagtgagccgagatcgcaccattgcactccagcctgggtgacaagagagaaactccatcttaaaaaaaaaaaaaaagtcagggatgatgacgatgtcaaacaaggagattgttcacatgggtgggtgacatagtgacacctttgctttctgatggtccaatgtacacaaattttgtttaatgcacaaaattatttaaaatattatacagaattgcctttaggccttatgaataagatgtatatggaacaaaaaaggaatttttagactcgggtcccatccccaagatatctcattatgtatatgcaaatattgcaaaatatgaaaaaatttgaaatccaaaacagttgtgttcccaagcatttcagataaaatacttaatttgtatgccaacctttcttgcctttcaaaccctaaatatagaggttacacagatccattaacctaatattagcacttattccaattagattccaagctcacagaagaaaggagcacagcgcagcttagtagaaatggggaaacaagcctagggatgccagttatacgctttgttcaaagtcacccaactaggctgtagccgacctagaactagcaaacaagtcttagaactcctcatgtttcagccattcaacagcactgaatattaactgtgttctagtctttgggaataaacaagatatttcagagatggctccctaaaagatattctatgtaaaacactgtgtgcttaattccatttccttaaaccactcacagatagttgaacaaacaataacatacgttgagaaactaaaaatatacctccaaatgtggaataaaagttttgtcactttcgagcgcaaccactttggcaccagcttcaagtaatgcctgagtcaggattccaggacctggcacattaacagaacgaaaagtttatttgtacaagaaacataatctctttcaataccaaactttcattagatgtttcacacgttattacctggtttttaaatctgacagcatccgcaaagtagatgtcactctcctttttacatataaggaaacaggagattatatatacttatttgactccagcgtcaaaagtgatgcagcttggctttgaaatcattgtcagcgactgcaaaacctgcactcttttttttttttttttgagacgaagtctcactctgtcacccaggctggagtgcagtggggcaatctcggctcactgcaacctctgcctcttgggttcaagcgattctcctgcctcagcctcccgagtagctgggattacaggcgcccgccaccacgcccggctaatttttgtattttaagcagagacggagtttcaccatgttggccaggctggtctggaactcctgacctcaagggaaccactcgcctcggcctctgaaagtgctggattacaggcgtgagccaccgcaccaggtcaaaacttgcactcttcatcaccatgattcactacctcttagaagaaaaaagtcacagcaaaatagattgcctctagcctatcacttcctcacggactacacggatgctttaaccatcaaagagattgtcaagcctaaacagaactgactccctgtgatatgaaatggtgctttaaaaaactatcattcaaaaagcctataaatcttgtgttcttagcatcctgctatggtctatagggaatgcacggaagaataagataacatcattttttcagctggcagaggcttgcaactcttttggggagataagatctaagagcatgttttatcaaaatattgtgtaaagtgcaagctgctacagaaatactttgtggtgtcattaacgatacagactctacgcttatgtagtgggcaatctctccaactaaggagcttcaaacaaagacccgtatctggacgggcgcagtggctcacgcctctaatcccagcattttgggagacctaggggggaggatcacgaggtcaagagatcgagaccatcctggccaacacggcgaaatcccgtctctagtaaaaataagaaaattagctgggcgtggtggcgcgcgcctgtagttcttgctactcgggaggctgaggcaggagaatcgcctgaacccggtacgcggaggttgcagggagccgagatcgccccactgcactccagcctggcaacacagcgagactccgtctcaaagcaaaagaacaacaaaaaagaccccccagtatctaaaatagcaccccgaggagggtcaatacgtttgaataaatgatgaacatccaagaaaatgcaattcagctggactcacctggattgcactccagcagtaggtgtggaggtctacttggttttcccaaatagatttgcgccagggtctcagccaatctccgatcggttacgtaacgcttaaagtctaagctggccttagacgccttccttggcggattcctgaaatccggttcgggccacagctgcggagaggagtcagagagcccacagtggttcctcgccggcaaatgctttcgcgtcgccgcttcagaccctaaaatgcaaaagcgaccagcgcccgccaaggcggagagcctcagccgccgaggaagcccgaccactgggatccacatgtccttgtctctcaggcccgctccaagaatcacctagtgcagctactacagtgaaccccacgcagggtatcccacgtggaacattttctggcgtccgggccaggtcaagcggaagtaaacactagagcctgcgcatgcgaacagcggagccttcctgcttttctccctcacttccgcttccgcctcggctcagccgcccgaggattgtgagtggaccgttgaggagagcgaccgaccatccggctggtgtccggactcgtactctatggttgtccgcgctctgcgcttcctctctagccgccagtgctctatgctccgcggtcgcgggccgccagcctccagccggccagccgcgaggggtgcgcagagggaggcggggcggaaaggcgagaggtgtctcctccaccggagccaggggagacccgagcaagctccgtgacagcacgtcggccgccatgtcgccgagtggggctggaaacagacccggcgcccagcggtagccctccttgcgcctccgattcccaggtgaggagaggaggagcgggatgcaggggacccgccggctcgcggccgggatggaaagcctttcggaagcctctcgctcctccccctgcgctgtcctcctccagccgcgcagcctctgccctccgggtgaggtgtagcccggtccccttacctcctccgcctctcaggtcgcctgttttcctctcctttctcagctactgtgggtctcctattgctgcgcgtcgcgccaatttctccctccctaggggactagcgccagaagtcgttcctcacccggctcctggaggagcctgcggcttccacggtctccgttcctttctgttgtgtggcccacagcccgctctccccaccctcgtggatggttttcatttcccccccacacctggtcccccccatcactaccactttggttgtcaagaaccgcgtggtgtctcccttccattcctctctctgggccaatattttccttaattttttcagtttgtgtgtttaaaagacttaaagttaagattaaaaatgaagatgtaaaagcttacaattcctttctaagcttaaaaagattaagactttaggatgcttactgtattccttatgtaaacttagtcaaacacatcgtactgtggaatgcgatttaaaagacccaattttgaagactaaaaataggatgctgtaatggaaattttggcagtctttttttttttacctattgggcaatgttagaagacacggttctttgagagtgttttccgtgtttcaggatcaaacttagagcttttacccattatccttaccaccaaggcaagaaacggcagccaatcaactccgtgtcttagaatacgtacaatcctttctgcttactctactgagagtgtaattgagtttggcatttaaatgcacgaggaaaaggttcctaaggaatgtatcacccagcaaatagtctgaagattatactcatctgatgaagctcaagcggataaagaattgacaactaaatatgaccttttgtgtattataaatttgttaggacatcatagaaaatatctcatcaactgttgtgcaaactgtggggactcactcattggtcttaatttgcttaaattcttttttcgtacagttttctcactgacaattttctagaggtgactttgcatcctctgaacctctctccattactgagctgcctccccctctccccttaaaaaacattttcatagattcagaaatacacttttttccccctccaggacctggagtcctaaatatttttaaatcagataaaatagaattatgtcttcatggttcactcatagaaatgtgtcgttgaatttctgactttttaaaaaaaacactgtggtggctgggtatggtagttcatgcctgtaatcccagcactttgggaggccaaggtgggaggatcacttgctgccgggagttcgaagccagactgggcaacatagactctgtctccttaaaaaaaaagaaagaaagaaaaagagaaaaagaaaaataaacacattgtggttaaaaacaaaacagttattttaaaatgcactgtcttatttcataatgtttgtggaccaaagttagcctactgagtcctagaaaaactgatgtcattttttattttgcttttgagtgttattattttctcttggttttgggaaagagaattacattataatattccctttttacagtgttgatggttcacttgtttgtaattgaaggtacttgaataataagagatttttgtacatcttattttttttctgaggtcccaggtgctgagaatgttgatttcaccttaaagatgaactttatgatcaggatttagacatactttattagaaaaacttgattagtgtgcagtatttcccatcttttttcttaagaagtgtggttttctatcctatgctgtttttgcctttttgaagtaattttgagatggagtctactctgtcgcctaggctggtgccatctcggttcactgcaacctccgcttttcgggttcaagcagtttctcctgcttcagcctcccgagtagctgggattacaggctcctgctactatgtccagctaatttttgtatttttagtagagacggagtttcgccatgttggccagggtggtcttgacctcaggtgatcctccgacctccacctctcaaagtgctgggattacaggcgtgagccaccacgcctttaaaatactttttttcttgctttttacatttaaatatatttatttatttgtgaaggcggagttttgctatgttgcccaggctggtctcaaattcctggcctcatgcaatcctcccacctcagcctcccaaaacactggtattacaggcatgagccaccacacccagcctcttttggcttttaaatgacaactgtaattgggaaatgccaagtgatagtccttgcttgctgttagaattaaggctgtaggtctgtagcagcagtcttcaatagaaatacaatgcaagccatataagtaatttaaaattttctagtagtggtattaagaaagtaaaaagaaacaggtaaaattttagtagtatattttatttaatcttatatatgttattttaacatgaaatcaatttttaaaatgagatattttacattatttgatactaaatctataaaatctggtattttatacttacagcacatctcagtttggagaagccacatttcaagtgctcaacagtcacatgtagctaaatgttaccttactgagcagcacaaatgataggatggtcacatgatttttaagctgtcttcctacactgagagtctgattctgtggggtaaattaaaaactcctcttcctgaagtactgcggtatttaatttgagaagtttctatgcaggaagagagttctaagtctcttccttttagtgtttttgttttgttttgtttgttttgagacagattctcattctattgcccaggctggagtgcagtggcagtcccggagccctgaactcctgggatcaaatgatccacctcaacctctcaaagtgttgagattacaggcgtagccaccatgcccagcctctttctcttagtgttgactgtgttaacgttgagccccatgcttgtttaatgaggctcataagatgaatagtgttcagtcatttcctggcgtgtcattgttactagttatttacatctgcacgtcaacagtgtgtcaaggcacagtatgagtttctgtcgactaaattgtagggagaacttgaggaccttcaagaagattgaactttattgtgaacaggtagagtacctgttgttgcagagttattttctgagtcagtttcaggtaaggctaagagttttataaatgtgcttctttatatcatggtgtttcttaccaagggaaagatcaaatctttgagcaaaatttagaaaggaagagagtaggttttatggctgtagaatgctgggagcctgagtaaagtaaaagattaacttgtgtatggtggtttaggggaatttaaaaggaaagatggcagtttttatataaagcaactgacatactgtctccatacgtgcttcaagttgtttttgcaacaagggtggtgatttacgtagaaccgtcagtggttcagagctgctgtaacaaaggtaactctaaagccagttaacctccatggggatcagtcagacccatcattgttcctgtcttgacctctgtgctctaataaacttccctaaatactactttagctgctgtgtgttatatctacattaatagctaaattagcctgaaggcctaattaatattcagtgtaatttaatacaggaaacatgccctcttctcaacctttatagtatgaagaaattttaaattacctggtcagtgaacaaactccctctgtcaaatatagtcatgatagacctggcacaatgtagggactatggggagtgttagaggatcaaagacagaattggggaaggggtatagttactggatgttacttgttctgtgagagatgtgtggatgttctataagaaaataataatgttttttgtttgtatttaaaactagatagctgtttattggcacccttttagttggataagagaaaatacattgcttggtttctacaagtgagtcttagcaaatttattgtagttattttaggaagagtaattgatagtgcagtaatcttcagtttttaaaaagccctgataaggtttaactgggctttaaaagcattatatgcttaatgagaaattctaacttaatatatgtatgtcttgatactgttatgtaacctttccagtttagggccttcaagattcacatgaatacaggctttcctttatgtaggaatcattctcatgggggaaattatatatcctctcagggaataattttgttttttaagcatttgaaataattgtttgtaatattcgttaaagaacacatcattagcagaattctgaagtcttataatagcttgagatttcttaaattgtttttatcctttttgagacagtcttgctctgtcgcccagggtggagtgcagtggtacgagatctcagctcactgcaacctccacctcctgggttcaagtgattctcctgcctcagcctcccaagtagctgagattacaggcgtgtgccaccacacccagctaattttttgtatttttagtagagacagggtttcactatgttggccaggctggtttcaaactcctgacctcaagtgatccgcccacctcagcctcccaaagtgctgggattaaaggcgtgagccactgtgccaggccaaatggtttttatcttagttttgagatcctgctctttaacattttggagatggaaactttttgccattataccctccacccttccgtctcttaggacttcctgtttttcatcatcattagccacgtggaaaggaaagacagtgtgtgcctatgaaaatactgacaaatcaagatgatttttccttttagattaagaaaaattctgaaacagtaaatggtaaattttgtcatatttatttacttattttagagatgaggtctcactatgttgcccagattagccttgaactcctgggctcaagtgatcctcctgctgtagcctcctgagctggggctataggcatgtgccacactgtctggttagtcacccttcattgacatttgggcatttgatatttaaattgacagtatctaggcaattatagaaattaacattattttgcaattggcatatgtattaaattttcttatgagaataattgccctgtttttttctggagagccactacctgattaaataatcacatattttttctaccttagctgcattttgaaaactcagtgaattaggtgactgtggttttctaatttgaatgaaggtaaagtaacctttaaaaatggtttttggccagtcacagccatgcctgggactcacgcctgtagtcctagctactctggaggctgaggtgggaggatcacctaagcacaggaggtcaaggctgcagtgaagcatgactgcaccactgtgctctgcactccagcctgggtgacagagtaagaccctgtctcaaaaatacatacataaatgaattaaatacttttttatattatagattttgaaataagttattaaaaaatttgggaactttataagatcaaatgctgctgtccttgagtatttgatagtatactgcttatattttgattttttgtatgcattgtccttgttcattatttttctcttctgcagcttttattcccagtatacaactaaatcttaaaaataatttttagatgaactgaaaaacattgcctaagatttttcaataaggatttttgtgaaaatgtgtgtggtttgttatttagagatgagatctcactgttttgcccaggctagtcctgaactcctgggctcaagtgatcctcctgccttgacttcccaaaatactgggattatagacgtgagccaccactcccagccaaatgtatgttttatttattgaataataaatagtggagttatttatttatgtgtgtgatatgtggtttttttaattattaattttttagaaaaatagaagcagggtttcgccatgttgcctagggtggtcttgaactcctgagctcgagcagagtgcctacttcagcctctcaaagtgctgggattacaggtgtgagtcactgcaccaggcctgagttatttgtttttacctcatgaaacaacaactaacattttagatttttttttccacttgtgaagcatgaaaaagtttacttaaattggatcttacaaggattcatgtaaccaacaggatttcctccctcagcgtcaactcacatgaaaagaggggtggacgtttgtgcaaattatactggttatgatattgtgaaatgtagtttcctggaaaagtcattattgatacccatttttggcatcttaattcaaattcagccatcaggctttattttaaatgatttacacagcaatctctagattcttcttgctacaagtattttaaaaattttgttgtggagttcttcggcatgccagttagagttatacctgtagcattggataagcactgtaaagagccaaaattagaggtaatacccttgctcttccctactttaatcatgtaatataggtcttgtgacttggaagaagattgtcttattaccattacatttgaacttttgttttaaaattaatctgttagatcatatattcaccaaagctcatcttttcactagccagagaaagctgtatttcaaaataacctaaagtaaaatagtatttaattcaagaagttagtttttattatatcaggtggcctcttggttggttatagtttcgtgcattctgatgcctgcgggctttttatccttcctgtctccactgcatagctggggaaaacctagggattgcccggtgaatgccaacagagctttaacctgtgtgtccatggcttgccttccctgaagcctcaaagagaacagctgcgagtgcaaaaaccttatgagcaaaatttctgctccaggaacacttatctgggctgaggaaacatattctaagaatatctgttttgtaactaaagcttccatgtacttgtgtaacgctttgtgtaaaaccacgtactttgtatagcctttgctggagagtttccattttcctccagctcttcagtgtaagtgaaaaaatgtgcccagaatgtctctatagattattctgccttccctcaccttttagttttttccatggaaagctgacaggtcagaataggcatattttattagaaactcgaagtggtggggggtagaagtacacatctttgcctcttttttccttcttgattacagaagtaataatgctccaaagatgttttttaataaaactgagtctcgctctgttgcccaggctggagtgcagtggcgtgatctcagctcactgcaagctccactactcctgggttcacgccattctcccgcctcagcctccggagtggctgggactacaggcacccgccaccgcgcccggctaattttttgtatttttattagagacgggatttcaccgtgttagccaggatggtctcgatctccttaccttgtgatccgcccgcctcggcctcccaaagtgttgggattacaggcgtgagccaccgctcccagccgctccaaagattttttaaaaagataaataaattttaacttgaggaaaacatggttattcaaaaattcgtgttttttctttttctttaaaaaaaattttttttagagacagcttgtcgcactatcacccaggttgccatgcagtggcaagattatagctccgtgcagcctcaaactcctggactcaagcaatcctcccacttcagcctccctagtagctgggactgcaggtatgcagtctaattttttttttttaactttttgcagagatagggcctccctgtgttgccccagctggtctagaactcctggcctcctccaggagcgatcctccagccttggcctcccaaagcacaatacgtgtatttttcagagggaattctcaactttcatcagatttttcaaggaatatgttactcaaaaaaggacaacaaccacagcatcagtttgacttggttggttattgcatgtccttcctaaatctctcttataagcagctatggctttataaggattcctatgtaaaagcatcatttttagtagtattttatttaaaacaaaaataatttaatagattatgaaggaaagtcatagtgagtcaaagaacaaatctgaacaaatcttcctcaagtattttatttatttatttatttatttatttatttatttatttttgagacagagtctcactctgttgcccaggctggagtgcagtggcacgatcttggctcactgcagcctccacctcccgggttcaagtgattctcgcctcagcctcccgagtagctgggattacaggcacccgccgccaagcctggctaatttttgtattttcagtagagacggggtttcatcatgttggccaggctggtcttgaactcctgacctcctgaccttttgtcaagtgttcagacaaaaacgtgcacaaatgtttataacagcattattcacaggagtcaaaaagtagaaacagcccaaatgtccatcaactgatgaatagataaataaaaggtggtatatctgtacagtggaagattctttggcaataaaaagaaatgaagtatcagtatatagtacaacatggataccccttgaaaacatgctgagtgaaagaagctaattgcaatagaccgcatattgtataattccatttacgtgaaatgtccagaatatgtaaatctatagagacagaaagtacatgagtggtttgagtgattgcctggggctgtggtgggggtgcaggagaatgggaaatcactgctagtgggtatgtagggcaggggggatcttttcggggtgataagatgttctagaattgattgtgtacaatttgtgaatactaaaagctattgaattgtgcattttaagtgggtgaattgtatggtatatgaattatatgtcgataaaggtgtcatgaaactcaactagaaaaaatacaagtttatcatagaaaatatgtaaaatacagagaagtggaagaggaaaaaagtaattagcatttttaaaaattccctatttttatttcaatgataaaaaataatataagcttattcaagaacaatactgacactttaaaacaacattctcatataagatttcagtgctctctgggcgcggtggctcgcgcctgtaacgcctgtaatcccagcactttgggaggccgaggcgagcagatcacttgaggtcaggaattcaagaccagcctggccaacatggtgaaaccgtgtccctactaaaaatgcaaaaattagccaggcatggtggcgggcgcctgtaatcccagatactctggaggctgaggcaggagaattggttgaacccgggaggtggagcttgcagtgagccgaaatggcgccattgcactccagcctgggcgacagagccagactccgtctcaaaaaaaaaaaaaaaaaaagaaacaaagatttctcagtaattggtggtgggagagttggatcctcacgtgcctatgataaccgtgcagtcacagtgtataccgtattccactagtgaacaaaactttaatttttacagagcagcatcgtgttcagtgactattattttaactttattgattttttttgcatgtcataattcgtaaatttgttttggtttaattgtgttagagttagaagcacataaaaattatgtttttacatccttttttttttttctgagatggagtctcactctgtcacccaggctggagtgcagtggtatgatctccactcactggaacctctgcctcccaggttcaagtgactctcctgcctcagcctctttagtagctgggaccgcaggcatgttaccacgcgcggcacatttttgtatttttaatagagacgggatttttccatattggccaggttggtctctaactcctgacctcaggtgatccacccccctcagccttccaaagtgctggggttacaggcgtgagccaccgcacccagccacaaattatatttcttaattctttttatcctattaccccttcccttggctaccaccccctaccctccacccacatccacagtgctttaagataaaggagattaatttcgcctgtaggaatccatgggaacttggccttcagacttcaggcaagcaccagagtggaaacatttggaagtctcattctaacatgtttttaccttaaaattttttaaaaattggattaggtttttatgtttttagaaccatcttgccctcccttttctagcttttgacgggacattgccaaattaataggctgttttgaagattactaagatgggcatctttcatttcagtagggaaaagaacatgtgctaaaggaattattcaggtgaaaatgcttttgtgattaaaaatgttcttcagaactgatacttctcatgaagtaaatttcaacagtacaagcaaaccctgttttcctgttgttatgactttgttgttctcacctgtcctccataccgccccaccacagcgtcactccctttatagcctcttcctactggtacctccttattccggttctctttctagaccctctactatcctctgtgtttattttgaactgaactttggattaaagtactacctttttgtagctgttactcaaagtttgtcttcacttgtgcttggaatttgaggttactctactgttgttcagactttacctttaaaattccaggagcatcctgttagtaaaacaatgagttttaaaaatttcggtaaaggtggtcataattcttacaggaaccagttttatcccatttagttcacagattttcattttgcctttttaatgggcatagaattctctttcatgtttttctgtagccgagaaacctagtcaagaatgtgaggtgaacctttcaagtaaaattgtagttgaagaaacaaaagtggaaaggctaggttaaaataaatttgaccctggcctaattccatttatctcatacccactttagaaaagaactaaaacagtctgtgcatggtggctcacacctatcatttctttgcgtttttactaattcatgcttcttttttggactttgctgactcgtccctgtattaatctttcactgacaaaaatatcctctgttctcaagtttccctcttctgtttcctaccagataatacttgtggtttttttgttgttaagtacattttaaacatcatctttagagatataaccatttttttctacatctgtttccttgggtaaaaggtagtgagagactttagtattgtagttcaattgaacaaacattaattaaacaccgttcatatgcctgggctatgttttggtgaggattgtaaaagaagtaatgggcacattctcctgctgcaagcattcaagcacttgaattccagatgggaaataatatatatgcatgaaataacttgagaaaaattctaaaacaataaataagcaaattcgagacagtgtctactaaataccaaataagttacagtgctttaaaataagctctaaaattatcgtgctctaaaaaatgggtctctgaaaatgtttcagtgtggattctgtattaaccattgccttcggctgggcgtggtggctcacgcctgtaatcccagcactttgggaggctgaggtgggcggatcatgaggtaggagatcgagaccatcctggctaacacggtgaaaccccgtctctactaaacatacaaaaaattagctgggtgtggtggcacgtgcctgtagtcccagctactcgggaggctgaggcaggagaattgcttgaacccgggaggcggaggttgcagtgagccaatatcgtgccactgcactccagcctaggcaacagagagactccgtttcaaaaaaaaaaaaactattgcctcaaattataattggcctcttctaaggctaaatagtattattacaatttctgttcctccttctcctcctaacttatcaaactcttcaaccccagctcaaattccatcttgcttatggaatctgccctacataccacaagcagcacagaatctggagccagtctgcctaggttgagtcctaattctgagaactgtttgactttggatgagttgctttacctattagtgcttcaaattgcttgtctgtaaaatgctagtgctaataataactacctaataggactgttgtgaggaattgttactatatgcatggcaaagcgtaagcactatataaatgtgtcttgttattctcatactctggtattacggtcacttctcacaatagacttaaacataaacatttctataaagtgatttatttgagcttaaatattttttggaattttatattttgtatattctgctctataatagctgtttgtgttaacataaaattagcatctctcttccatcctcacctttagaagtgaattgatgttaccagagagtgtccatttatcatcctgtgactttgcagatccctggtcagctttttctctttcctgtttctgttaagtatgtattcattctgccttgttgcccattaggttctgcatgtgtgcttttcactaccttattataagctcttcctcccaaggagcaatgctgtttcagtgatgacaacaaatgtgattattgaactcttagtgctatgcatcttgctatcactagaaaattcatgattcacaaatagccagtagctgggctaggtggctcacacctgtaatcccaacactttgggaggccaaaacaggaggatcacttgagcccaggagttcaagaccagcccaggaaacatggtaaaactccatctcttctaaaaatgcaaaaatggtgggcacctgtaattccagctacttgggaggctgaggcaggagaatcactagaacctgggaggcggaggttgcagtgagccaagattgccccactgcactccagcctgggcgacagagtgagactctgtctcaaataaataaaaataaaaatcacacagagtcctcagcagagtaaataaaacaaaatttctagcggttgacatctggagactatttacaaggatgttcttaatttatctttatggatgactttagcagtttcccataaattgtctcattttattcttacagcaaagaaacaaaggcttatagagttgaactaatttgactaagatttcacagctggcgagtatcagaaaactgtatttgcactgagaagggaatgactccaaaattagagcttcctttcttactgctctgtcttatctctagtcttagttcttgttttgaaagggaacttctggtacttacgaatgacggggcttatcttcttgaaagtggtaataaactgtactaaatttctaaggttaaaaaattaagatgtaacattaccagttttctcttttattgatggtttccttagattttttttaaataaataatctcttgtacctttttttgagaactgtatgtagatttcattctggacatataaatattaagggttaggtagcatttaaagtatttgtggtcagaaattaaatgaatgcatgaaatactgtactcttttgagtaaattctaaaaataatccctaatcatttcattacagacagttggacattattttgccatttaccaatatactttttttttaatataccttaaagaccagagagaaaggtaagaacagttatgaaattgcacttctctgattagaagacttattcaggaggactggaagcagaattttcagacgtttctttctaaatggattctattaacttccacagtactttgttcatagcagaccttcaaatatttggttggcttcatgcaaaaaggaggtatctctttactcccttctgtattgctgatgctaattgaattatcttttaaagattcagcatattttacggggatttaattttgagaacattggtgtctttctgaaggtttctttttttttctttttttttgagacagtctcactctgttgcccaggctagagtgcagtatcatgatcttagctcactgcaacctctgcccccagggttcaagcgattgccccgcctcagcttcctgagtaactgggattacaggcgcgcgccaccacacccggctaatttttgtattttcagtagacgggatttcaccatgttggccaggctggtcttgagctcctgacctcaagtgatccccccaccttggcttcccaaagtgctgggattacaggcatgcgccaccacgcccagcctgaaggtttctttatagcatgtaaaaaaaatgtaattcatcgaaatatccactcacatcctgatacttccttgagtaataatcttctgtctttagttgctatttctgtcctgtattttcattgcaattgtatgcttttcttctttaaccattcccatacatggatatggtaacagccacattggatgaaacttcatcagtgtctccatgctgtattttttctacccataccaatctttttttttgagacggagttttgcttttgttgcccaggctggagtgcaatggcgcaatcttggctcactgcaacctgtctcccgggttcaagcaattctcctgcctcagcctcccgagtagctggaattacaggcatgcgcctccacgcctggctgattttgtatttttagtagagacagggtttctccatgttggtcaggctggtcccgaactcctgagctcgggtgatccgcccaccttggcctcccaaagtgctgggattccaggcgtgagccatcacacccggcccatcccaatcttttagaaacgtagtctgggtccttgtaaagcacatggttgcttaaaaacattccattacagctgcaaactcctaatgtgttctagaggacattgcattttacattttccatttcttataaacttttacaaaagcaatataagtaaatagctgataaagtgttctttgtggctttgaagaaacgttagtagcttaggagatgccctttaccagcagcccgttagtacttggtttatattattttttattcatatgtctgagctggattctgtagggagaaatgaaaaatgttttataggcaaaattttatgagatgtctgctaatatcataggcaaaagtatttttgcaatatgtattatatctaattaatttaatggtatccagtataatataatatcctttaactggggtttttttaaatagaagtgtcttttcattacagcttaaaagatggttgtaaactttcatataagtcaagtacgcagttgttaataaccttatatgtatgtactccttatatttagcaagatgaaatttttcagatccatatgctaagagttatcagatttactggcccttcacacaaatcaaaaaacgaagttaaacacgactttgctgttgctgtttttctttcctctgccttctcccactgtattctatctctcaccatctgttactgacagttatcagcatagagtgacctgtacctggaggtgggttcataactgtcttttaccttccacatctactcagtcctgcaaactgtgaactccacctccatgcttttttttttttttgaggtggagtccctgtctcccagcctggagtgcagtggtgtgatcccggctccctgcaacctccgcctcccaggttcaagtgattttcctgcctcagcctccctagtagctggaattacaggcacgagccactgagcctggccgggcttacgttttgtatccttctcccctttaccccctagtaattggttcatggcccactaggggaagaaaagatggtctttcacaacagatagtctgaaaagcgctggtctcaattcctgtactgggctctggccccgcctccgtttatcaggctcgtcactactttacttcagcactcttattccaaagtctaactattcgctgttcattctgtacttcctcacctttttatttggtcctgtttatttcttctcttgagattacctctccatgcacctcaggtacgagtagaatggagggaacacaccatctcagagctgggttacaatgtcctcttgtccagtgttatctgctatatcaacatttcctccagaccgtggctgaagatgaacaaggcagctcagcagattgaaggtgcctggggccagcactcattcgccctgtctgagaaacgcagggacctccctgaccctgttgtccgcccgttagcgtgatgagcagctgtggatttcatctgtgtttcttgggcaggggggcctgtaggtatagaaatggatactaccaattggattggctgatttaatacctcatgaatatcagtaccttcatgagtattttgtgtctcctctggtcttgtgaatatttggtggttatgagtgctttcattccttcctgtgtttaccatacagatgccctgtttactttctctgtgtctaacttctcacgctgtttgctctgcacttattttcatctcttttatttgtatctttgattttctgtaatggaattggatattctcaaatattcacgcattacacctttccacagtaaaagtaaccttcattcctctgactctcaaagaaattgcctgtcattgatcacattcttctttgtagcaaagtttttttgagagaagaggaatgttagggcagggtttatagacatagcgtataattcattacctgctagagtatcagctcttgtatttttattagctacttttagaatatatagtcctcagggcatgttgtgtctcatctgtctctctcttgcctcattgtatttagtatgtggatcttgtttgttgtagacactcaaaattgattaccctgaaggctggtgaagtttagttaaagctctgaggtcagagttcagtctcatgtggagacttatttgctttgtttcatgtcctcatagtaaccttgaatgctggccaagtggcttttggttacaaagagcactgggtaagacaaagaattagcacttgtattgcataagcagtttaaaaccagtgttcctctgaatgtggggcaggagcatcgtgttcccattcaaagggcaacattatatcataatttttcaagataagaaaaagtagacaatgaggatggcagaagaaaatatatgtgaatttgcctgtaactgtactttttttttctttttaagaggcaaggtcttgctgtgtttcccaggctggagtgaagggatggtcatagctcactgctgccttgaactgctgggctttaagcagtcctcctgccgcagcttcctgagtagctagaaccacaggcacacgccaccaagctcacctaatattttagagtgtctgtagagatggggtctcgcttcaagacccaggctggtcttaaatccctggtctcaagcgatcctcgcagagtgctgagccaccatgcccagccacatatgttggctttcttgtataggtataagaattcagtgatgtatctatgttagaagaatccgaaatcgctaagaaatatgaaatttcaaattcacttatataagtcaacattttaagaattaattttctttaagtgaagtaaaccaggggcaagagtttcaaaaaatgcattcagatgtccacataaagtgggaagaatggcggtgcagtcaagaataaagagggagcacaaatgaaaattggtgtcgagatagactgaagaaacctggtctttccattatgatgaaaaaaattccagcgtaggtatcagtcttattgatactttgtactcaagtagaagattaaggtacaggattcttttagccagattgtggatgatctgcatgatgagattgatttgaagacagtgtatgaaaccaagtcgaatggagacggagtgtgtagtggaactcatctcagtagaccgtcccggcagccctgcagtcctccacagctgccaggacagttactgttcagtttcccacactggctattttaaaccttctatatgctccccaactccttgctcccaacataccactccctccctgcctccggtatatggatctcctatgagtctgtttctgctgtttttttcccccagttttcttttttaaatcaagacgtgatctcttgtatgcctggttgttttggattatatactgaatattacatatgaaaagttgtggaaatagtttcagcctttgctggatttatcttgcagagaggattgactttagtttctggcaggcaacaggttagaacagaccaccttaattcaaccagagattagatgattgattctgctgggccttagtccctgtgagcactgatctatttcaggcttgccttttcttctggggagtatcacttttaggtcccaccgcaaggcctgtggtcccctcttcttggaagacctcgaactctggtttttcgtccagctctgtgagcctgctcaacactctgctcagcttttccggcttccaaactgaagctttctgccagcttttctagtgatcagcaggaggggtttgtctgaaatgagccagtctgcccttgccagaagtacaagctttcttatgtttgtttttgcacatgtttaaaatgacagagccaggtgctggctcacatctgtaatcccagcactttgggaggccgaggcgggcaaatcacttgaggtcaggagttcgagatcagcctgtccaacatggcgaaaccctgcatgtactaaaaatacaaaaattagccaggcgtagtggtgcatgcctgtaatcccagctactcaggtggctgaggcggcagaatcacttgaatcgggaggcagaggttgcagtgagccaagatcacaccactgccttccagcctgggcaacagagactctgtctcaaaaaaaaaaaaaaaaaaaaaatatacacacacacacacacacacacacacacacacacacacacacacactatatatgtatacagcataagtgcatatgatttatgaacagatatacctacagtgggtatactcaacgatcagtttctttgcctacgctgggcgtggtggcatacatctgtaatcctggcactttgggaggctgaggtggcaggatcacttgaggccaagagtttgagaccagcctgggcaacatagtgagactctgtttctacaaaaaatttaaaaattagctggatgtgatggcacgcacctgtagtcccagctatttgggaggctaaggtgggaggattgcttgagcccaggagttcaaggctgcaatgagctatgaccttgccactgcactccagcctgggggacaaagtgagaccatgtcttgggggagagggggagatatatatatatatatatgtgtgtgtgtgtgtgtgtgtgtgtgtgtgtatatattactgatagtatgcttataagcaaagatatatggtatatctttgatatgtatctttattatatagtatatataatatataccttttattatatctgatatatattatatataaagctatatatctttgatatatttctatatataagatacatatacaagctctatcttatgtatcatctatatcaactttatatgagataaataagatacatagatatataaaagatctatatcaaagatatatcaaatatataacatatcttttatatatatctatatatgatatatatgcaagctatatcttatgtatctcatatatatcttagctatatctgagatatataaataatatataaatatataaatataagtacaccaccaaagtttggagactcttgcatgttagtccctcttttttaacgtgatgttggttcagtaagtatctgtggcctgcctggtaaaaatttttctaaatgcacaaagatgaatgtcagagatcttacgataatttctaatggggcggttatatagcccaacatataaacctgaagaaatggactcataacattaaaggaatgcagcaaataaagagtcttattggtgggttttatttgctgtgtaacctatttttctacattgtacatatttggaaaacatctcaagatattggaaattgttcattttgtggcctccttaaagtagcaatttggtatttacaacatatacacctgaaaacagctggtttttaaaagtaatttaaaaatgattatagtggttaaggatacaggctctggaatcagattctaaattgaatcctggctttgccacataatagcagcgtgactgaggcctatgcgtttaatctttctattgctgtttacttctataaaaaatggaaataattttagaactactttataggacttataaggattaaattatatatatgtaataaacttaaaacactgatacttagtaaatcttcaataactgttaaagagatggagtcttgctatgttgcgcaggccggtctggtactcccaggctgaagcaagcttctcacctcagcctcttgagtagctgacactacaggccacaccactgtgcccgactagtctcagcattttattcagataatgcaagctattttgtcaggcatcttaaaagaaggttctaataaattatttgcttttgccattgtattttcaagaattgacattttaaaacaatgtatagttttatgtgtctatttaatgagtaaagtataagacagtttccatgaggatatatagttgatacaggcagtaaacatgatttttgttttaaaagaggtggctatagtctgaaccaaagtattttcaagtcttagattctgttggttgtggcttaaaagaatgattgcagtacatttttacaacaaagaggtatttaaaaccaaataagcacaatttggatgtgtttacttctcttttgtttatttaagtaaaacttgtgtatatctgtgcataagagaaggaaaagagaagagagatgactctttatcttcatactgcttgggtatacccacaatgaggcttttgacctgtcatttccatttatgtaatggattttgaactcaaaagccctgtaaatacataagcgatcttgaaccaagccccattgtgaaaggcaggattgaggaatatgaaacaaattatgcttcctttcattcactttatctgccccaaggtttttttcggaatatgagtcacatagtttcagttaatttcttcatatttttaacagtgctttctcttcataaccgaaaatctgtatttgatgtttttttcccttagaatcattatcttcacatttattcttgtttttccttttgtgtcttgtaactttgtcacatttttatccttcttgcctaccttatagcataaattttctcttctgtggcctttctttttgctaaatgaagaactaaatctttatgaaattatattttttatttttattaaagaaatgttaaaacaatgtgatttacttttatactgtactattatgtagaaatttaagtatttagaatgattactgaaaggccgttttactagttttaatgacaatactatttaacttttatgaagtgccaggggtatttggaatatggggaagtacaaaaaaaaaggaacagcatgatctagtgatttacattgtgaatatgggaaataaggaggtaaaaattaattttaaatagtatctatttccttccacaagtatttgcatttgtttaattacagtaataataatatctatatccaggaaatacctatagcataacttgtgttagcaaggaagaatccagaatggagtgattcaccatgagccatatttggctactgtgacactgtcaaggcaatgtcatagacagcagcatcgtccaatagaaatatgtgagacatatatgtaattttgtggtctagtaaccacattaaaaattttcaaagggaaaattaattttagtaatagtttattcaatatatctaaagtattatttcaacatacaatcaatgtgtagaattaataaattcttttatattgattttattcatactaaatcattgaaatatggtatgtattttataaatgtagcacatcttaatttggacacaattttcattggaaatgcttgaactatatttcaatttcataaaatgtacaggtgaaaaacattcacatacccaagttattccaaacatacttgagtttttcagtaactgaattgatgtccatttaaaaatttaaatttattaaaatttataaaaatgaaaaattgagtccctcaatgtgtgttcatatttcaggtactcaatagccctgtgtggttagtggctaccattttgaatagcataggtatagaatagagctcacagttgaagatgtcagctaagaaaccctgaatcattattattattgttttattttattttattattattatactttaagttttagggtacatgtgcacaatgtgcaggtttgttacatatgtattcatgtgccatgttggtgtgctgcacccattaactcgtcatctagcattaggtatatctcctaatgctatccctccccctccccccaccccacaacagtccctgatgtgtgatgttccccttcctgtgtccatgtgttctcattgttcagttcccacctatgagtgagaacatgcggtgtttggttttttgtccttgtgatagtttgctgagaatgatggtttccagcttcatccatgtccctacaaaggacatgaactcatcattttttatggatgcatagtattccatggtgtatatgtgccacattttcttaatccagtctatcattgttggacatttgcgttggttccaagtctttgctattgtgaatagtgccacaataaacatacatatgcatgtgtctttatagcagcatgatttataatcctttgggtgtatacccagtaatgggatggctgggtcaaatgatatttctagttctagatccctgaggaattgccatactgtcttccacaatggttgaactagtttacagtcctaccaacagtgtaaaagtgtccctgtttctccacatcctctccagcacctgttgtttcctgactttttaatgattgccattctaactggtgtgagatggtatctcactgtggttttgatttgcatttctctgatggccagtgatgatgagcattttttcatgtgtgttttggctgcataaatgtcttcttttgagaagtgtctgttcatatccttcgcccactttttgatggggttgtttgtttttttcttgtaaatttgtttgagttcattgtagattctggacattagccctttgtcagatgagtaggttgcaaaaattttctcccattctgtagttttaatgaactcctcattaaagaaggaagaggctttattcgggcgggagctttggcagacttgcatcttaagagccaagctccctgaaaaagaaatccttggcccttttaagggcttacaactctaaggggtccacgtgaaagggtcgtgatagatcgagcaagcgtggggagcgtgactgggggctacatgcatcagctgacaggacagaaagtttcgcagggcttcctcatacgatgtctggaatttacagataacacaagtagtttaggtcaggggttaatattattattatttttttaaccaccagggccaggtggtggtgccagggtcgtctggctatttatcttacttctgtttctttccaactttttgctttctcccttttcgcctgtcttataaactaggcaaaagtgggagagaggagggcagcaggagaagtggtggtctccttccttaatggtatagggtgaatattttatcttgtacttttcatggttttagagactgtactttacatgtttctaaagattaagcatttctactcattaagttgaagaatctttagaagtcctctcactgaggtttttttccagaattactggattatttctttcatacctatcatttttcttaaaatgtaatacacttgtagataataagaggaaataaaagatgactgataaagggcttgcagtctgttttgtaaattttaaaaatattagtggtatccttcaagcagatttagcatttcttccaattctacactaagagtagcctagagttaaccatggcctttttttttttttttttaagtgttcaaaaggattttgatgacaactctaaggtaccttccagggcttatttttaggaaataaaaaataaaacgatagtataaatatatgctacctaaacttcccctcacatacttttttctaggttatttttttttaaaatcttcaaacattttcatttccaaatattgctgctgtttagccagagaagaacttatacaactagctttcagttgtctgctgagtgtccagggattaacataagagactaatttcagcacataacctatttaactagtcatttcattcaggcagtggtcccaacctgatgcacattagacttacctagagaacttgaaaaatagtggtgcctaggttccatcctcagagattctgatgtaatggtctagaatagaatttgggcagcctctcaggtgatcatcatgaggagacaggcttgacacctgtagtattcatgtgagaactagctgagtttggggttgggttgcatatggtgaaagggaatgaacttaagtcatttccttctcttccctatttacaatgaaacaacctaagagaaggggaaaatcaaagatcactgagaatctgcaaaggttagaaaatgaagtagcttttttctttttgtcattgtagacatggaaggtctttaatgtaactttaaatggttcaccaaaggatgctctaatggatgacagcgatactcctacatattatctgcaaatagaaccacaagatggatgtcatcctggtgacagcgtggaaaggagtgtgacctgtctgccttctgcatcagatgaaaatgaaaatcagcttgacggggacgggcatgagcatctgaccagcagtgacagtgcgatgggaaagccccaagtgtctgagcaggacagtctcaataataatgaaagctgcacattgagctgcgaggtggctgcaggtgagaacttgcaaaacaccctttgtgaagcctccagagatgaacaggccttcttgggaaaggacaaaaaaattcctggaaaaagaagtccaagaagcaaaaaagggactgctaagaagataccaccaggtattgtttaaaatagtatttatcctcttctttaattaattaaaaatgaacctccttccctcccatactgtgtttactgtcctgcaccttgcttctttgcttacgatattctggagctagttccgccgcagcacaagtagatccaactgcatgatattccagtgtgatacgtctccacactgttccaccgtatgggtgtaacacaatttatttaatcacttccttatggcccttcccagtcttttactatcataaacagtgctgaggccgggtacggtggctcacgcctgtaattagcactttgggaggccgaggtgggcggattacctgaggtcgggagttcaagaccagcctggccaacatggtgaaacgccatctctactaaaaatacaaaaaatgagctgggtgcagtggcgtgtacctgtaatcccagctactctggaggctgaggcaggagaatcgcttgaacctgggaggcggaggttgcagtaagccaagatcacgccactgtactctagcctggctacagagtgagacttcgtctcaaaaaaaaagaaaagaaaaagtgctgaaattgacatcctttgtacatgttttcacattaggtactttaaatatatgcagcctcctctccctcctttataaattagaccattttctaccaatatcaaccttaaaaattgccttctgtcattcctgtggctttgatccctaacctgtgagtttagatgctactgtgacctctttatagatctttccatctcactcagcaggtaaataaaatacaggaacatatattaatgtacaatttaatatgtagtgttgaataagacatctggttctaattatctgtatcactttggttaaaaagtaattcagagtatttcttgtttggtatgcagtttggcagttgaagtttagagctatggaatttttggcctgaatcacagggcccccttgggaaaaggcagcctctggttattttttttatcagaaacatatgggactagaaagttttggtatgccctagactggattccttagtgtagtaccactttttacccaagccaacagattttacatcagactctagtgaactaagtagaatgcctcttcatcttctgttctcttctttggttaattagaaatatatctgtctatatcgtattttttatttgtatttttaaaatttgaagtaaaatacaaaacttttcagtttctacaaaatccatatttattcaataaagtaatttgaaaactttttaatataattcataatctggctttctggttaatgtaactcataatttggcttttcacgtccctgtatctttttcttagtagactcaaaataatttttaaccagggatatgaaagctttttttttttttcttttttttgaggcgagtctcactctgtcacccagtatggagtgcagtggtgcaatctcagctcactgcaacctccgcctcctggattcaagcaattctccttcctcagatgattctcctgcctcagcctcctgagtagctgggatcacaggtgtgcaccaccatgcccagctaattttttttgtatttttaatagagacaaggtttcaccatgttggccaggctggtctcaaactcctgacctcgtgatccgcccacctctgcctcccaaagtgctgggattaaaggcgtgagccaccgtgcccagcaaaagcatttcttaaaagatctaataagcagaggatatttacagtactatgtatatataaatcagtttattctataactatcattcaagggcaaattcaccaggcctctcaatctgattttgtgattttattttattttcaagacagggtttcactctgtcacccaggctgaagtgcagtggcgtgaccatggctctctgcagccttgatctcccaggcacaagcgattctcccacctcagcctctggagtagctcggacaacaggcatgtgctaccatgcctgactaatttttcttttctttttatttttgtagataaagaatctcgcactgttgcccaggctgatcttgaatttctggcctcaagcgatcctcctgcctaggcctcccaaagtgttgggattacaggcatcttgtgatgtctttaagaactgatacttagttgcatacctatgagtcagtcatagctttaagattgtgagtccttttactcctcccttccatggtctttattccacttttcttaggtgtgattatattattattatatttattttagagacaggatcatgctaccttgcccaggttagtttcaaactcctgggttcaagtgatccttttatctcagcttcttgagtacctgggactacaggtatacaccagtgggcccagcttataatttaaagttatttagtatttataatactgtgagaagatatgtttagaattactattccctaatgcatttgaaacatatgatttataaaatctagggatagtctttatacagcttactttaaacattattttctatatcttatataaagtgagtttaagagagtaagaaaggccaggcgtggtggctcacacctgtaatcccagcactttgggaggctgacagggcagatcacttgcgctcaggagttcgagaccagcctggccaacatggtgaaaccccatctctaaaaaaatacaaaaattagctgggcctggtggcatgcacctgtagtcccagctacttgggaggctgaggtgagagaatggtttgagcctgggaggcggaggttgcagtgagccaagatcctgccactgcactccagtctaggcgatagtgccagaccttgtctcaaaagagtaagaaaacagaatgaggagttataaaacccaagtacaaatcttatgattccaggtcacttggtgagactgaagcagtctctaccttgttgttgtcgtctgtataatgatgatcttcatctacctaaatctatgaaattcctttttaagctgtgagtttcttagatttcatagtagagatggtatactctatacttgaataaaatgtggtgattcacctctagtgcatctatagagtttttatattttacagatacatttttgtttgtcttttaagttttgttgataaattaaaagaaaggatactcctgtctgcccgggctggccatggacgaggcgggactgagtgtcctggggtgagttagcagggcacaggtgtttgagatgggggacccttaattttaaactgaataggattcttttgggtgtggaattaatcctttctagatgtggaagagacctagaatgggaagaagctttagtattgcctggaaagcttccctcagagtttagttgctgggaccccaccctaagaacttgcttcagcctgtcgtctctcagtacgtatccatcacccggtctgagtaatgttatctccctgtgatctctcaagtcagtctgtttctctccatcttcactgccacagttcagcagcatcttcagctggagtactgcaaaagccccctacatttgtttcccatcttgcttccatcctccatgtcaaaaataatgcaaagagtttatgcataggagtttagacaaggatgtgtttactctaatttttcggttaaattcttagctcctaagtaaataaagtttcaaatttttcagacgtgtacttttctaataattgaatagcttctcaaatgtgaaatgacatataaaaaacatgatattcagttgcaaaccagaaatgcagttttttgtaggtagatgttcttgtaacactttttagaaaatgtaaaatataaaaataaagaaaaaaaagaccaaaaaaaagaacatgtaaaataaagtaaatttattcactctatgctcccttgtctagtttaatttgtagtcatttttcaattactactgtccaaaggctagtactggaaaaaaaatgatagtgcaggactcttgtcactaatagtcatgtcattcctaatagtcatgtcattaggagacatgtcactgtttatgggtttgctggaggcagtatttgtgtcaatgggtaaaaccttgatcttagcctcagggaagtccagttgtcatcatataatgagcttttttttttcccccttaagagaattgaatccccttgatatgcttaactaagcaggatttcaagctgtgttacaacaagttttcattatagggcgggtgcactggctcatgcctataattgtagcactttaagaagccaaggtggaggattgcttgagccaaggagtttgtgaccagcctgggcaacacagggagacctcatctctacaaaaagtaaaataattagctgggcatggtggcacgtgcctgtagtcccagctacttgggaggctgaggtgggaggatcacagcagcagtgagctgcatggttgcaccactgcaccccaacttggagacagagtgagatcctgtctcaaaaaaaaaaaaagaaaaagaaaaaatttttcactgtagttaaaatggcaaagctttaggtaaatattatcctaaaaactaatgaccattacttatttattattatttttcacattcttacctggggggagaaaaacaatggaaattaatgtgttttttaaacagttttattaagatgtaattcatatacatgcaattcacctacttaaaatatataattcactgatttttggtatactcacagggatgtgtaaccatcagcagtcaattttagtatgttttcttcaccacacaaagcagccacttacatattagcacccacttcttacttccacttagacatcctaacctgaggcagccattaatctacttactttttctacagatttgtctactctgaacattgcatattagtggaatcatacaatagaaggtctttgactggcttctttcatttaacatgttttcatggttgacccattttgtagcatatatcagtactttgttcctttttgtggtcagataatattctgttgcatggatagaccgtatttcatttatacatcagctgagggatgtttgggttctttccactttttgactattctatggacattgctgtacaagtttttgtagagacatgtgttttcatttctcttcgttatatatctctaggagtggaattgctggatcatatggtaactttatgccaaacagttttccaaagcaactgcaccattttacagtcctgccagcactgtatgagggttacagtttctctccatcttcaccaacacctgttaatatctgactatttgattatctccatgtagttttaaaaaacttgtaattcgtataccataaaattcacctttttaaagggtacaatttagtggttttagtatattcacaaagttgtacaatttaattccagaacattttatcctccaggaagaaatcacgtacccattagcagtcactcctcattcttcccttccccaagcggtggctaccactgtcccataaagtttgtatatttgtatgagacaagtttagatgatgtgttttatggttgtcgtaacaacactagatatttactcagcgctagtcaccatagtatcaaagcatttaacaaaacagttcagcaaatggcgggaagccagaaataggcagcacatggaaactgggaagggaagacctttctcaattgacctgccactatcagtgccctgacttgtttctctggaggccttcacagtgtggccagctgaaggatgacaaggaggctagaaccttaaaaagcctgagtcaggctggtgtagtgagaacaaagactttggatttgaatcttggttatttgagtctcggttctgcctgttcttacctatatgatcttagaaaaggagctcatttccctgaaccccttttctcatctgtaaggaaggctgatcctacatgtcttgcaggattgtccttagaatgaatgactctgtatgtaaagcactttgtaaagtacccagcataaaacagcttcttctaaatggtagttgttgtgtttatgtgtgtcacaagatggtatttatttatttatttatttatttaagacaggattttgttctgtcacctaggctggagtgcagtggcgtgctcgtggctcaaaaacatcctcaagttcccaggctcaggtgattctctcacctcagcctcccaagtagctgggactacaagcgcatgccgctgcgctcagctgaattttttttttttttttgtagtggcgggtttttgtcatgttgcccaggctggtcctgaattcctaggctcaagccatccaccagctttggccccctaaagtgctaggattagaggcaggagccactgcaccagctacacaagatgatttctgagtggcgtgactgggagtaccattaagcaaaattaagaaattaatttgatttgactttaagtccattttacttcttttgtcagtacttttttttatttcctaggaactttttaatactgtctcttttcagatgtacctgtccctgccccattcccctaatgtacattcctaaaaatatatttccagttccatactagtttaatgtcagatgcaacctgctttttgggatgttaactgatatcaaaagtaataactagtaatgccataaaatatgaatccccaaaggcctatttgcatttttatatattgacttcggctatagtagaacattgatagctggcctctaaatcagctttatggagacaattgggtaatatctgtactggccagagttgagatccctgagattggtggggactgtggtgaacaggagtctacatcatgccctgcctaagtgcattcaaatttttaaaatgtaaatgcctggctaagcccctgtaagcagaatgatagggactggggttgatgttttgtgattgtaacccattctactcactaggtagatagacggacagtttaactcccttaggagtacataccacactttcagaattcagaagtcctggtttaccttatttctgctcctagtagatgttccacctcttttaagttaacatttctttggacaatgacatgcagaaacagtagcctctcattttactcttccttctttaagggattgatcaatgaaggcaggccatgtcttttctgaaggtcagctagtaagaatagaataaagagttcctgatttatatagagtcaaataatttcacagtcagaagagacttcaaggtcactagccaaaactgtcttaggaaaaaaaaaaaaaagccccaatattaaaagtgtgttagttttctattgctactggaacaagttatcacaaatttacaaatctagtggctttaaacacacgacaacacaaatttattatcttacagttctgtagatgaagaatctgacatggttcctactgggctaacatcaaggtgttagcagggctgtgtccctttctggatgctccctgggagaatctgtttccttgccttttccggattctagaggcttcccacattccccagcttctgttacccttcctccatcttcaaggccagcagtggctttgaagtgagctcaagtcctcacattgcatcactttgaccagctgacacttctgcctctctcttccacgtttaaggtcccttgtgattacactgggtccacccatatattgcaggataatctccctttttaaagatcagctgggctgggcgcaatggctcacacctgtaatcccaacactttgggaggctaaagcgagcagcatatttataagttctgggtatggggacatgggcatctttgggagctgttattctgcctaccacaaaaagattttaatatagactagatgataactttacataacagaataattcttcactttataaaagtttttctgacattattttgtagacccgtacaggattacatagtcaatagatatttattgagcattgttgctgggcactataaaactgctggtgcacctccctttcagttttgtatgctcaagtgagggagccacgtaactaacaagtgcagtctagcaagacgggagtcataagtaagcacatggtcgtggaggtaacctgtcctggagagttagagaaggttgtcaggaggagttggtatctaagctgagttaggacaaataggtgctagtgaagtaaaagcaatgcggacaaagaggagaggaaggacgtcagagatggcaggcgtaccatgggctagagctcacaagacaagaagagagcatcctacatttcagtatctgctaatattcctgcttgagcagaataaaagaaaagagtgaatcaaggggaaatagtagagagtagagcagtagagagatggaggcttagaagattagcaaagtccagcttataaattgtttttaacatgaccagtttgggccttaacaacaggtttgaataagggaattgcattttttagaagattcctcagtctgcagtgtggagaattggttggagcaatggaagattagaagtaatacagagttaaggggttttacagtaacatctgccagagatgctggtgatctgtaatgagagagtagctgtacggctggagagaagtaagtgaattcagagttactaaggaggtggaattaacaggactggatcattaattagatatgaaaaaaagagtccaggataatctaattctcagttatctggtttaagcaccaggatgcttgataatgccatttattgatttattgagcataggaatacagggagagaaagagcaagtttggagagaagagagtagaagacagtgttgtgcttttgggtcaggtgtctggggtgtcgtagacgtctgagtagacctgttaaacaggcttctggtcttggctagagatacagatttgggagagttgctagagagggccttaaaagtgacctagtctaacttcttagattttacatgtgaggaagttaaagatttaattgagagaatacattgttcatttttgcaggagacagaataagaattaggatgtgaatctagggctcctaatgagctagaatgtgttttctatgcatcagaggcctacttctcccaccaaacaatgagacgccaggcatggtggctcacacctgtaatcccagcactttgggaggccgaggcaggaggactgcttgagtcaaggggtttcaagaccagcctgggcaacacagtaggacctggtcttttcaaaaaataaaaaaaatagcaggcgtggtggcatacatctgtagtcccagctactcaggagactgaggcaggaggatcacttgagcctgggaggtcaaggctgcagtgagccatgatcacgccactgcactccatcctgtgacagaatgagactcttgtctcaaaaaattaaaaaacaaaacaatacaaaacaatgaggttctgttggtagggtaaaaatgatgatgagccaccaactgttagtgattttttctattgtagaaatatttgccaagcattaggaatacagtaaggacaaagcagatcttgtgcttaccctcctagacccctggtggagtccagtgggaaggcaggtattaaataaaattaatggcctggcacggtggctcacacctgtaatcccagcactttgggaggctgaggcgggtgaatcacctgaggtcaggagttggagaccggcctgaccaacatggagaaaccccatctctactaaaaatgcaaaattagctgggcgtggtggcacatgcctgtaattccagctactcaggaggctgaggcgggagaaacacttcaacctgggaggcggaggttgcagtgagccgagatcatgccattgcattctagcctgggcaacaagagcgaaactcagtctcaaaaataaaataaaataataaataaataaataaaattattgcaagggtgtatagtctgcttctagaactgacacacattcactgtgtgtgtgtggaatggaatggagagagcagtttggaagatggtaggagatgagttttgaagtattacctcttggatattctgaatgctaatgagagaaaaccctttagtggaaagcttagttaagggttgatagttgggagtaacacaccacctacttataagaggaccctaaactgatggttagaatgatagaaatgcattccctgctgttatctagctctttccaacagactgcaccatttccaggagtgttgggaaaggtgtttgttacaattgaaagtacaaacgtcagaggaagggatcaacaaaatataataaaaaagcagaaaattgaagaattgtgcatggtctgtgcattagctatctcttgcagcgtaacaaaacttagcagctgaaaacagcaaacatgtatcatctcgtggtttttgtgggtcagaatctgtgtgtggcttagcttggagcttctgacttaagtctcttatgaggttgcagtcaagggttggccagggctatagtcatctcaaggtttgatagaggttggataatctgcttccaaggtcacatggttcttggcaggcttcagaccctcgccacatggcccactccacagggctgccttacaccatgacagctggcttcctccagggctagcagtcaaagagagagagcactcaacctggaagtcatacttttttaatgacctaattttggaagtgatattccatcacttctgcatattcctttcattagaagcaggttactgggtccaacttgtacttatgggaggaggttgtaaaagggcacaaataccaagaggcaggaatcacgggggcccatcttaaaggatgccaggagaaagtcggtgcctcagattgtggcaaggaccccgtgagaatgtaatggcaattctattcacagttccttttttccctctgaacacctttcctgagattgcaggtggaacccaggatatatgatggtacagacagcccagttagatagttttctttttgtctagttttttttttttatgatttcagtcgtgctgttaaaatgcagtatctatgcagagagaaggtgaaaaagaaaagaattacaatcaatcaaacctttcaaattctgtcccaaaaaacagcattctccaagtctcagtaatgagttaggtattttttaagtaatgtgatattttatgtgaagaaaaattaagaaatcaaaactaagaaattaagagatttacctccagatgcatgggaatatttatgcagttacatacatattaacctagatgaatgaagactttttaaaagtttttagatataagcatataggctatattttaaaatacggtattttattactgattttataggactcagattagtggaagcttaggtgggagtttagggactcttggcttctcagttctttactgtgaaagtcaaactttccaatatttaatcgttttctaaatagtcaccttttgcttttctgtttactccttttgtttttactggatcacgatctctacaaagagtgactgttttgtcttcatttgtttaaaataatggtttctaggcatcactgatagggtgagaactacaattaagagttttttgttgtcttgtttttttaaacaaagttatatgcgcctgccgcttagtttgtaaaaggcacacaagtgaacatttggaaatgtagtcacacaaatgaaaagcaggtagaggttatatgcatgctatttagcaatgaaaataaataaaatcctaatacatggtgtaacatggatgaatcttgaaaaggtgctaagtgaaagaggacatatgtgtgaaatgtccagaataggcaaatctatatggacagcaagtagatgagttggctgcctagagctagggaggcagtagggggatggggtgacagctaaaggatgtgggatttctctttggggtaataaacgttccaaaatgtaacatggtgatggttgtacaacacagtatactgaagtaaagccactgaattatgtgttatgagaattatatctcagtaaagccgttaaaagaaaaaaaggctggacgtggtggctcacactgtaatcccaccactttgggaggcctaggcgggtggatcacctgaggtcaggagtttgagaccagcctggccaactggccaacacggtgaaaccccatctctactaaaactacaaaaactagccgggggtggtggcgcgtgcctgtaccattataggcatgagccaccctgcccggctactggagagactgaggcaggagaattgcttgaacccgggtggcagaggctgcagtgagccgatatcgcgccattgcactccagcctgggcgaagacgcaagactccatctcaaaaaaaagaaaaaaaaaaggggcttggtgatagttggtttgatgatatgaagaaacggtgtagttatttgtctccacaaaatttaaaaactactagtgtaatggaaattgatgtaacaattttctgtaaactataataaaatgccattaaatgtgtttctctgtgcgtttgttttgatctattgaaagttcagggttaacccctgggcttctaatgcttccgttcttatatgatttcattaattgcaaagagaatctctgatgttagtagcttttagagaattatggaatattaaagaaggggggcttttaaggaaaatttcactgtttggtttgctttggctattaggctctcccccttctcccacaaatatatatattttcaggagacggaatatatatatataatacttatatttattgttattattttgagttgcactcttgctgtattgctcatgctggagtgcaatggcgtgatctccgcccactgcaacctctgccttctgggttcaagcgattctcttgcctcagcctcccaagtagctgggattacaggcatgcaccaccatgcctggctaatttttggatttttagtagagatggggttttaccatattggccaggctggtctcagactcctgacctcatgattcgcctgcctcggcctcccagagtgctgggattacaggcgtgagccaccgcacatgcaccattatttttgttttgaatttaaatacatgcctttatatttgttagagaaacaaaatatgtttattttcagacatacgagaaaatcatatacttgtaagaaaatcatatactttcttataaggtcatgtaaattttgagaattctgatagttgatgaattcagtgtgcttggaatgaacagggaaaatatggtaaaatttagccattttgatattagcaaagtcagtgtacttccaatggataaacaatgaatttaatcggatttgaaaaatccaaaatatggtgcttgagttgtttgtggacctggataagtagttttaagaatttggctaggcacggtgactcacacttataatcccagcattttgggaggccaaagcaagggagtcgcttgagtccatgagttaaagaacagcctgggccgggcgcggtggctcacgcctgcaaggctctaatatcagttggaaccccgggagcgcgccaacagacagcacaaggcggtgtggagcatcacgctgttttaatgcgcgcctgggtgcagacgggctgaggcctaaaatggcgtcagcgccacatgaggacggggcaggggttttacagtctcctgtaaacaggaagtgtccctgtctgatgtaacggctacgtggtacctggatggcctctctgtctatcctcggtggtgggtgtcttccggccggggtgcgtgtcttccggccggggtaggtgtcttccggccggggtaggtgtcttccggccggggtaggtgtcttccggccggggtgcgtgtcttccggccggggtaggtgtcttccggccggggtaggtgtcttccggccggggtgcgtgtcttccagccggggtaggtgtcttccggccggggtgcgtgtcttccggccggccctcttcctgcttctgcttctcgctgacgcgcgctgctggtgcaagcggccttgcgccttgggactgggtctgaggagggaggagttattcatccccccaagctttcggccccggggagaatctttcattcctgtctatttggttatagaaaaagggaaaaggggcgactttctccataactacttcaggtgtgacatagggggtggcgtgggcacctcggaaaaaaagaaaaaattttggcgtattcttgagagacgggttggtatccatcgtgtcgttgtagcaggagcatcgtctggattgtctggcggttaactgtagtttcaacaagagttttaatggcttttattatcagtgggataccacaggggagaaacaggaggaccccaatgatgaagattactgtccctaccagcgttttaaatccccctaaattagagaaccaccctcctagaaggtttgttgggtcccatcccttccaggtttggactggtacacgggctacttttctgatgtttgaagcgatttctagaaccgcttttccattatcatctatgttaagacagcaattggacatgttaaacttagcacagaccgcaccctcttctgttaataagtagtctagagccagcctgttttgataaattgctgggtgcgtttggttttgttgtcacacgagcatttccagggctgaggcggtttggttagtgattatctctagagcagcctgtagtctaattattctatttaggatatatgtgggagtgcgataaccccgtgaaccatcctcagcccaggtggcaggaccgtaatattcgatgatccattgcggaggccactcgtcctctcacggtctttggcttcctcctgcctttaaggaccgtttttctctggttatcatacgcagggactccgagggtgttgcccgcctgctttggaagtaagatgaatccaggttgaattgtgcgtaggaagctagtgctaaggtagccgtgagcaagcctgggttccccatatccaaaggaatccatcggggcagtccgtcgtcagctggtgttcctaggattgtcgcatagtgcacttaggcaggcgtatgtggcagaagagttagtggtgtttgtacagttccaggccttttttgacaagacacaattgaggtagctgaagttagagggagaccaggctccggggggtaaccttggccaccactcggctgtggaggcgttgactgttagggtttggtgacgggctttcacctgcggcacgatgggttttatcagtccacttgcgggatatgcacgccgtccctcttactgggttggtaagtgtccaggtcgacgggcgttcctgagaattcaaagtgaggctggggttttgaaatgctagtaattaagggggaaggtctatcccatgccacggccactgttcactcctgcgggctcccccgcatacccagcaattggacacattcgtggtaagcgcgatgccctctcctagatctacaaaccggttttttcctggctagggaggggatacgtctgcttatggtttttgtataaagggatggaagtaccacgggtgattttcgggggagttaaccccgggagcgcgccaacagacagcacaaggcagtgtggagcctcacgctgtttaaagagcgcctgggtgcagacgggctgaggcctgagatggcgtcagccccacgtgaggaccgggcaggggttttacagtctcctgtaaacaggaagtgtccctgtctgacgtcactgctacgtggtacccggatggcctctctctcgatcctcaggagtaatgtcttccggccagccctcttcctgcttcggctaccttggtgacacatgctgctggcgcaagtgtgctttgggactgggcctgagaagggaggagttattcatccccccaagctttcaggccccggggagaatctttcaacgcttacaatcccagcactttgggagacagaggtgggcggatcacgaggccaagagatcgcgaccatccagaccaacatggtgaaaccccatctctactgaaaatacaaaaattagccgggcatggtgtcacccgcctgtagtcccagctgctcgggaggctgaggcaggagaatcccttgaaccggggaggtgaacattgcagtgagccgagattgcaccactgcactccagcccggcaacagagcaagactccgtctcaaaaaacaaaacaacaagaaaacagaacaaaacaaaacaaaaaccagcctggaaaacatagagaacctgtctctacaaaaaaaacaaataaataaataataaataaataatttaaattagctgggcatggtggcatgtgcctgaggtcccattgactcaagaggctgaggtaggaggatcatcactagaccccatgagttcgagtttgtatgatcctgccactgtactgtagcctgggcaacagagaccctgtctttaacgtttttttaaaaaagaagaggtttaagaattagcatcacaaattgcatgcttgggcaaatgtcttacacagttttagtttttaataaaacgtgttaaagtgtaaaatgtctaatcaaacttctgagaggaaaagtagagaatccaaacattaatgcttattgacatgttctacataatttagatgctaaatcccagaaatatttatgtgtactgattgtgccttgattagaaagcctgaagcaggctctagacagtggtggagcttgcgggagtcacataaatgctgtgtgatcaacaggatttaagcccgtgggttacctgcttttacaacctaagcaccaagggatggggagccttggccgttagcagcctaagggagctcttgttcccacgcatttttcaaattccactggagtttcatgaggttcgttttaagactgccacctgaaatcaagtccagtggctgttcctgtcttcccgtccctgtattgacattaaaaccacttagtcaacactcaagtgcaagaatagtgtcgccatgttgtatgcctagtaaattctggatgtacgttgtacgtcaccttatttaaccttttgccattagtttacaagaagacgggttgagcgagtcaggttgcttactttaggttaacagggcagctggactccagcctaagctcttcagtgaagccctgcatcactccctctgcaggcagagggtgcaacccgggggtgtgggagggagcatggcacactcagcacgtggtaattatgtcataatcacataatacattcttttggcccgaggtcaggtcagaaggaagttgactaatttccagatttatttcagtcataatacccgtgtctagtgttgaggaaaaggaagggatgtttcctgtttgctgcttcggtatggttagccaatgactggaggtatttaaaaggtgagcactggccaggcacggcagctcacgcctttaatgccagcactttgagaggctgaggcaggcggatcacctgaggccatgagtttgagaccagcctggccaacatggcaaaaccccgtctctactaaaactacaaaaaattatatgggcatggtggtgggcgcctgtaatcccagctacttgggaggctgaagcaggagaattgcttgaacctgggaggcagaggctgcagtgagccgagatcatgccatggcactccagcctgggcaacaagaacggaactctgtctcaaagaaaaaaaagtgagcattgtccttcaccctcctttccattttcatggcattgatcagaaccttagaggatgaaacatgtcagaaaaagggagcagggcagagagattcttcacaggaaccacatcaagcgtgtgttaaaatttatttctgatctgccttccaaaattatgcccaagatatgcatcagcattaatgggtaaggcggtttgaggaattcggttatgcaatgactcaaagacccattaaatcacagaactgaagacatttttttctgtacataaatgtgccattttaaccatttcattctacagttcagtggcattaattacattcataatgttgtgcaaccatcatttatatctatttctaaaacttttatctccccaaacagaatctctgtgccattaaacaataactcccagccaggcgcagtggctcaggcctgtaatcccagcactttgggaggctgaggcgggtggatcatgaggtcaggagttcaagactggcctggtcaagatggtgaaaccccatctctactaaaaatacaaaaaattagccaggcatggtagcgagcacctgtaatcccagctacttgggaggctgaggcaaagaattgcttgaacccagaaggcagaggttgtagtgagctgagatcgtgccactgcactccagcctgggcaatggagcgagactccgtcgcaaaaacaaacaaacaaacaaaaaacctccccattcttttttatattttctgtcttttttattgatattctcattttttcctacattgtcttcctgatttcctttagttcttcatctatggtttcttttaagacagttgatttaaattctttgcccaggaaattcaatgtctcggcttcttccgggatgttttctgtctatgtatttctttcaccagaatgggccacactgtactgtttttttgatatgcttggtgatgtctttgtattgaaaaccggacattggtgtattatgatgtggtaactctggaaattagggtctcgcctttgttcagggttggctgttcttgattgctgaagccttagcttgtgtttcttttccagtctttcagattggctctgtgctcaggtactcctttaacacttagccaggtcatctataattctgccccagccttcacttctgcttgcactaagttgatgggtcttctctggccctttctaagcgtgcgtcgtgtcctgagctgtcgcgtgtagctttctgaattctacagtaccacaaacatttttgaatgctctgatttcccaaggaagcgatcttcctggcttttccccctggctttagattgtctagtttatgcctcaaccgtattttttttgcacccctccgcccgcttggccgtgggtttttgatcacctgacaatattttccagcaacacctgctgcttttctgctctgaacgtgttctgagttttgcaacagagaggcaagtgccttgtttcagtctttgggtagccccagacagattagaacaaacacagtgatttgcaagtaagatctgctctgctcccttcaaaagcaagtactggggtgccacactgggaatgagggctgctgttgagctggggaaaggggtgaggtaagggcaagtaaaaacacccaaagctttgctactcttttgacattgcctttctcttgattcggtggtcactgtcttgttcaggcatacctttgtttttcacagttctaagaaagttacatcttatagttctggatgttgtttttttttaaaatatttctgtgaaagcctcagagtttgaagctgcctgttctgtcattttgcttatgacactcaaggccttttcattttagggcttccagtagcaagaactgtgcccagagggatggaattagatcgaactgctctgaaagagtactactatttcatatttttatacaaaagcatattttagataaggatgtcattgatttagaaactcaaaccaattaatctttgggaagtaatattatctctgttttagag
